United States Patent 10,724,096 (METHODS AND COMPOSITIONS FOR INHIBITING AND TREATING NEUROLOGICAL CONDITIONS) - sequence listing, part 58

SEQ ID NO: 1367 - DNA, 1986005 bp, Homo sapiens
aaaagataaggatttagctcttaccagcctgttctcctctcctctcaccttctctttctacattcatgcaataatttttggtttaaatctatgttcaagttttacattgttgaatcatataaataagttgtagctaagccatgtaatacaatatggttacattgctttgtataatttttatttttcctttgattaataacttgatttttttcttatttgtacctatccctaattcattcccaactgaattttaaacattttaaagttcagcttacacattgatttttaaaattgtgtttacacgttgattttaaaatgtaagcattagggataggtaaaaagtgaataagcaaagtgaataagcacattctgtgaataagcactgaactaatggagttaaaacatgaatcaaaatatatacagataaattagatgtaggaaaaacaatcagaaccttcagtgacattttacaatcttatcaaaaagatatgttagcatttagactatttcaggtaatatagtaaacagttgattccccgtaagcaatgtatcaaagaaataactatcaaaataactgcatttatgtatagtgtgtactaaaatctctagtgttaacttatgtaacctcattttgttcatctccatcataaacattgtatccttctaatttaattagttcaatgttttttggttcctgaaaaaatacaacatctttaattttgccaacaaaattggttttaaaaatctcttgagtaacgatatttacctttctaccatattcaaagccccctagataacaaatgccatcatagtttagagccacaaagtttttatgtggatcaatatcctcggaaagaattagactgttatttatgtaggccttgataagagtctgattttgaattacaactacatggtgccatttattacaacagaatgtgccattgttatagctcataggcacagagattctttctcccaagttaactgctattttcaaggtctgattatggagaccaattgccagaaaatcattttcttcattttgagctattcccatccatacaattagaccttctgttttagtggtactgaaatttaaggatatagtagtgaactggaggtttctcattctataatttggatcaatgtatttaatgtaagaattacccataaattttgcagttgaaaatgaagttttgttttcacaataccttcccacccaacccaaagtacacaggcaactgtaagaaaatgattggtcaggtatacataaagattggtggaggcaaagattattcaaacaggacacagactggttacatgtatttccagcccaatctggcaaacatctgcaagaaaaagttgtgccatttactgtacattcacctccatttctgcatgtgttgtacccacaggctgtcccatcacagtcacctacatttgagccaccttttgctccaaattcagttaattgtaattcttgattatttatgataacttgtcggatacagccttgaaaacctacaggttcattttctattgccatgggatttacaagatttaaagaagatactcctccaatatagaagtctgtatttgtgtccagagaactcattttagtggaggccttttctgttacatttatcccatctagatccaggtagccttctgcaccaactcttcctgcttttattatatgccaagtacttccgtttatagttactttttggagagtttctagaatgatagttctgtcgccaaggttgtagcgaagttgaacggaactatttactaaagagatgcataaaaaatcacctgcaagaaagcaaacagtaagtttgattagcaacagtaaaagtttccattgaaaacttttgctgtttctggccaagttggataagttttagttatggggaaaaaagtaacagatcttgagcacaattgtgttagttttgtttccactcacagagcaaaatgcatatatcctgtattctttcattttgttcagcaattggctacataaattttctctagttgtggacagttctcattgaatgaatatattgtggtagtaagttaaagtgaggtttttcttcaaatgaaagcctgttccttatgataccatttaatggcattcactattgtcaggctaggtacctataaattctctgcacattcctggctcctttcctgtctctccaaccttacctggaatgttctctttccccatccttacactctctttacttcaacaacactgactttgttaattaaggatttcattcgcctgttttctaggaacactccgccaccccattccacctcaactagataactcctacctgtccttcaggtttcagatcaagtgtcacttcctcagagaagttttccttgatttcccagagctggtcaggaatttttttctgtcagtgccttaatatcactaggtttccctccattacagtatatctcattttataattatatagtcgtgtgaagaaataggaacaaataccatccagcatctgaagttgcaatgaggcattcagaagaaaagtaaaggcaattctgcaagcttggaaaaagcatgttcttcactgtaagattgcttgaagaggatagcaaaatgacttattaataatgaaccacgcagaagtctccacgaaacattttcttctccctctgaaatttcccaacctttttcttttctcatccagggatattcggcattatgctacactacttcttcctccctccagagtgcctatttccacacctccctcctgcaaatggtgttctttccttctattctccattgtggtctataccaagccattctagactggttggaatgtttggcagctctatagttcttcacctatcaaactacgttctctagctttattttcctcatagggaatttttagtgagtatactatgtcgttacatatgtgatatttggttaacagctgctttatccactaggttgtaagctttatgagaacagggtctgtgtttggtttggtccaacagttgattcccagcacccaaaacggtatctggcccataaatagatgctaaataattattaaataaagaaatacgtttgtagggttgtgggttgagatgactcagaatatttctcaaataatagttttagcttgaaagcaaaaacttttttcctataatgacatgaaaattgttttaaaaattcataacaaagaaactcagtttatttgcataatttctaacatgtatagcatttttaactataaggaaagagaagcaacattataaactttcagattaggaaagaaaaaatatacattgggttataccaccaaaaactggaacaagtaaacataattgataattaagttcaaaaaatttatagcaacctaaatatactttgtggcctgcaagtgaacacaaaccagttatcttttgcaagattatggaggaagcttttcttgctccttgtgttgtagagtgttcctgtagtaaacaattttatagtgaagagctacattagaataaaaaatatctaagaaatgattaggaaagctgaagctgtgatctatactatcactggtcatgttgccaaccagaagaaagagcaaggatagcttctgcgaagaaaggattattttaactcagctagtatgttcttacgaaaaattgacaaaaagttttctttctgtggctatggaagctaaaagctgtattagcttaaaaaatcatagacttttaaatttcattgcgttaggatatgatgctctagttatgggtcataagtacacattggcattattattattattattattattattattattattattattattttgagaccagagtcctgctctgtcccccaagctggagtgcaatggtgcaatctcggctcactgcaacctccatctcccgggctgcctcagtttcccgagtatctgggactacaggcactggccatcacggccggctaatttttgtattttgggtagagcgaggttttaccatgttggccaggctggtcttgacctcctgacttcaggtgatccgcccacctcggcctcccaaagtggtgggattacaggcatatgccactgcacctggccttggattcgcattagagtaagaaaatgtaatgaacagtccttacaagaaacagagctcaaataggataaagatcataaatgaattcactttggctatttaatgcccactcaaccatggctgaggcttctcccacctttgttctgctattgtttctacctcatcatctgctatcccaccgtgctttattatagataagagaaaccttgtaggacctaatatttgtgaagagactacagaatcagcatatcaggggaattgtatatacatttttttctgtagaaaaggaaagcaatggtaatttaaacttatttatatatttttaatatagtttaattatttgagtatgttttaacttcacattgcaatgactaggcctttttatacacgttgggaggattataactatatcagatgaattcaggctttgattaatttgtgcttaacaaaatgttgataatttttatatatcaaaaatcttttaaaggtgttaaatttttagcagaaatagatgaaaagggaccagagtcttatttctttaaaatatctttcaaaaatcagagatctgagatcatctagtataattttcaagttatcattttgttttaaattttacactacttgagagtactcaaattattaacctctaaagagatacagaaaccatgttaatttagaatttggttttcaatatgtgaaaaccacattggctgcttttattaaaatttttggattttaactttgtgtattgtttggttagtttttactaataggtcctcttagcagaggatcaactatgaagacttggttaatgtttacatcaggcacagttcttagagaaggtacaaagtacaggactgtcagctgcattttctgcaaccttaaataaatgagagacttcaaataaacttgttatatcacttgattactaaaaaataagtttatgcctttcatctgataattgtttttggttaatctaggtttaagcatgtagaacttatatttttaatatttaaaaattttcatgattttcttatataagtgtcaaatgcagcatcaatcgtgtgaaactaatgaatctctgtaagtagtgtctgatggcataaaaaaggaaactcttgattgtcttgaactacatgcattgaataacagatgtaagaagatgtgctcttgccctcctatgtgtattagtgtgtatgagctttatatttcatatacacaaacaaatatgtatcgttgtactgattataaaactgtagtacaatattcccagccagtcacaatcctgaatataccttgattttctgccctcttacataggtcccacttaacattaattttgagttttattagcaatataactgaagctgattgtcttttaatgtctcttgatttataaatagaaaatttatgtttgtatgtggttctcctatttgacattttcacagggagatttaatcatgaatttaaaaccaaatatctcaggagaacaaatttcttctgagctgtattttatagctcaattgtactttttctctttgaaattattttgagggtatttcagaagtgcattgaggtggaaccactttggtcgaattccctgatattcttatcatttagaagcaagtcaagacacttctataagaactacttagattatgatcattagagcaccatttttgctaatgatgtgaaatttagcaaatgtaattatttctcaatatcaaaattgtttctcattttctgagagacaagatcaaagaaagtcaaatgtaagattttaaaaatacttagcaatagagatgtaactatatgtgcagatgtctttgtcagaattttggagaaatgaatgaaaatggatatcaagggtaaagtaaaacctaaaaaattaaattttaaaacactaattggatactttatttcatattttatgataaatatgtaccttttaaaatcctaaaatgtttttgtaagcatttcagaacacaaatcctgggtttactgtttggatgacagaacaacttaaagagaatttttggagctataaatgtggttgaatctacaggaaatgtatcagccatgccttccttttaaaaaatcttttatatgcatattttgtctcctttgacatagtactatcgtgcatggctttaatgtcttttttgatggtattgtttttaagttgagcatatactatatttagattttgcaaactttaattccaacaaatctgttgctattttattagaatatctagggcttctaaattcatacgcatacacttgcagtgacaatagaacataaaagcatcaaatgtttacatatttaaatactaggtgacacaaacactatcatacattacttaatagactattaggaattcattctgcaaacaaacagcctgccaatcttacctgattgggcttttaagtgttgtgcagcataaaataggataccatctgcagcgagaggctgaaactgcaattgaatatgtgtcttttttcgaacatgaaaggaagcaaaagacatccaggataactcattgcttctgaaagatggatcacttatggataaagctgagggaaggagagaaagagaactctgggagttatctgctggattaaaaaacattgctcataaatacaataaactgcttatgtaattttgtaatttcaggatttatcgcccaagagttgcttgtaggtgagtacatcaaaccttggtaactttgtgagtctgttttaattccactaactttagggttttgtaacgaagtcacttactgaaaagccttctcttgcttctggtaactatgcctttttggccgatactatctgacacaaatcttctgctctagattgcattatatagagggatcagatgcatagctgaaattcttggaaatgtcttacatttataatgctttcagaaagttcaaatgttggaagatagaggacaacactttataagttattcttcagcctctatatttctgattcaaatacagagtataattgagtcaggatatattataaggcataatatattgatttttttttttgcttctgtgtataactgacccaatgggaattatgagagggagatggaaagttctgcacatttggccagtttttatccctatgaaatctatattccttcttcttttcttataatgttacagtgcttcttagagtgcgccctggttcaggacatagcttagccattaatctagttatttagttttctccctgctctgtggaccaggcgtatgctaacggctccttttactttagattgaataattggtaggtgtttatccaagaggtgttggcatttgctgattttttttaaaaaactgtactcattcatttcgacttattgctattcagaagggtagaggttagaatcacctgatcgtgttgccaagaatgcaaagcgctatacctcattcctagagggcctgatttattaaagccaggatggaggctgggcacggtggctcactcctgtaatcccagcactttgggaggctgaggctggaggattgcttgagctcaggagtttgagaccagcctgagcaacatggcgaaacaccatctctcaaaaaaaaaaaaaaaaaaaaaaaaaaaaaaaatatatatatatatgttagctgggcatggtggcgaatgcctgtggtcccagctactggggaggctgaagtggaaggatcagttgagcttgggaggtggaggtgggggtggaggtgggggtggaggttgcagtaagctgagatggcaccactgcactccagcttgggcgacggagtgggaccctgtcgtaaaaaaaaaaaatgctgggatgggattcagaaagcatccccatttttaataaaccctcctggtgtttctgacataggggttccttggaccacattttcataaaatctggttaaaattttaagaacacaagggtgatttaaaatgtgagtgtccttttgaaactttttaaaatattgctaaattaatacatgtttattataagacaaacaatataaaagtgtataacattttttaagtgaaatttcattgtttctcctctcttaatcccaagaattactgttaagtttattgtacatgtagccagactttaaaaaaatacacatacaattaacatatgcatatatctaatacttgatttattttaaataaaaccacattttatataaactatgcataagtaattgcttttttccatctatctttgtgaaactgatattagcatattttgcctatcacttcttttaaatacatggaaggtatttttaaaagtacactttattttttcagagccattttaggttcactgcaaaactgagtggaaagtattagggtttccatataccccttgtctcaacacatgcgcagccttctccactgtcagtattgcccactagagtacatttgttaaatggatgactctatattgacacatcattatcacataagttcatcatttacataggattcactcttcacgtacattctatggattttgacaaatgcgttgtgaaatttatttaccattacagtatcatacataaaatcatacatcatatcctctttgcttgcctatttgactctccctccaccctggcaaccactgatctttttttactgacttcatggttttgccttttccagtatatcatatagttggaatcatacagtttgaacacaagttttcagctcctttggacaaataccaaggaacacaattgcttgatcatatggtaagagcatttttagttttgtaagaaactgcccaattgtcttccaaaattgttgtacaattttgcattaccagtaatgaatgagagttcctattgttccatatccttgctggctttaggtgataagtgttcgggttttagctattcgaaaaagtatctagtgttatccaattattataatttgtaatttcctaatgatgtaagatgttgagcattttcatatgctcatttgccatctgaatatcttctgtagtgaggtttatgtttagatattttgcccattttaaaaattgagttaatttttgtgttgaattttaagaattccttgtttactttggatagcagttctctatcagatatatattttgcaaatattttctgccagtctgtggcttgtattctcactctctttcatgtgtctttgacagattagttttttaattttaatgaaatctaatttatcaatttttttctttcatggattctgcctttggttggcatctagaaactcatcatcaaactcaaagtcatctagattttctcttatattttcttctaggagttttatagttttttattttacatttaggccttgaatccattttgagttaaattttgtgaaagatgtcatgtctgtgtctagattcttttttttttttctttttgcatgtggatgtccatttcttctagcatcatttgtcgaaaagattatcctttccccattttattcttcttcctcttttgtcaaagagcagttgactctattttgtggcataatattttataaaatggatataggatgatttccttagcagttccctcattgaagggtaactaggctattttcagttgtattccatttctcctggtttcccaccctatctctctagcttcatgtgcccctgtcttataaattttataattcctcagggctttccatagcccatctctcttcttttctttccattagtgacctctcatctaattccatgactttaagaaatacctatacatatgataactccttgaaaatttacgtctatctaaacctcttctgtcagcttcagttttatatagtcatctctcttattgattatttgttttggctatatgagttatatcgaacttaacatgtttgaagttgtactgctgaaagatactcttccctcagccttcctcagatcagcaaatggtcccaccacccattcaaagccccatgtagaaacttggtaatcaatttgattgtgctgtttccaaaatttcctttatgtttcccaatataatgcattaatagattatagctgcatgatatatttcatatttgccccatctttctattaccactgccaccatccaagttgatgccactatcaactcttgattagaccattgcaatgtactcctcattgatctttttactttttgtcttaatctcttcacatacattttatatatctgccagagaaaccttttgaaaacatcaattcattgccctctttaaacccttcagggattttacttagaataaaatgcagattctttaccatagcctctggagctttgcatgatttggcctcctgttaaattcccaacattcccaccattgtgcatatggtgcactgcataaccccaaggggaagtcatcacattgtaatttatgtgaatagtgttccctggagatgttcaatgaacaatctacatggaaatatgatgctacttttcctccttttctttaaacttcagatgcactggcttttactactggatttgtcatagtttgattatcttagattaattataccacaatttacttaaccactgccatgttgccatgttttgagttgcttgaaattattttgttatcgtctgggcatggtggctcatgcctgtaatctcagcactttgggagggcaaggtgggcggatcacgaggtcaagagatcgagaccaacctggccaacatgatgaaaccccgtctctactaaaaatacaaaaaattagctgggcatggtggtgcgcacctgtagccccagctattcaggaggctgaggcaggaggatcgcttgaacttgggaggcagaggttgcagtgagttgagatcgcaccactgcactctagcctggtgacagagcaagactccacttcaaaaaaaattattttgttattactaatactgataaacatacttaattatatctcgttttaaacatgtgagaaatggaatcgcagtgtgatggtctgtgttcatttttagagttaatagatgccaccaaactacactctaaagtgtccacaaccagcagagggtgacagaatatccttatatatatcctcaagcacacttgagattattgaaattttaagtttttagcagtcataatgattccattttattttaatttgcattttgctgattacaagtgaagttgagtttctcgtgtgaatattggccatttgtgtttttctgtgacttttttgtttatgtctgttgtatgtttttaaattcgatttgcaatttttaaaatgtcttctgagtcctaatcctttcttatatctattgcaagtatatcctcatatttgtcatttttctttcaactttacttatggtatgctattcaaaatttttaagtttgtatttaccaatattcttggtcttttacaatttacttgttttgtcttatttaaaaacattactcaacacatagttatgtataatcatctatatttttccctcagagattctagttttgcattctatatttttttaccataaatttgtatgtttttaaatttataggcctttaacttatgtggctcatagtattgtgaatagtttgagctagaaatcaagctttatgttataagcagatagctaatatttttcaaaaattaatagtttgtcctctttgtttgtatttgatacacacttttagcatcttacaagtaatattttccctctccctcttgaggaagtgtttgtaggaaatattgaacagaatgaagaatgcagataaaaaacacctataaggctaggttttgtggtagtacctatttggctttgctgctttcctttggctggatttaacatctgggagggggggtctcaagaatggaagagttcagtcaacaacagcatgatgagagggttccctgttacccagtggggaggagctcgaattgtatttcaagaggaagcttttgctgaaactattgctgatactgggtcagtgcaggagttgagaattatctgtgcacatgtgagcgtatcataaaacagctgacctcctaactcgtgcttttccaaagaagtgacacatgctgaaattatatgtaaatgtcactgaactaaacctcaaaagaaatgaattttattaatagctctgacattgtatgttttgagaagatgctcaatacatattttttatataacaagaaaggcttcagctctaatagcttattatttgattaagtattcagtaacaaagtactggggaggattgcattttctaataataatacacattcaaaatattggtgcaagatgtcatttcaaaaagaggtacatttttatttagcagcttcaaggataaactagaacaggaaaaatgactatgcttagtatgactcaaatgtttattttatagattaaaataaagtcaagagaaaaattgaggtggacataccagtgattagtcattgagatacgcccaattatttcttgtatgtctatcaactcctaaaaatgatcactttgtggtgaaaatattccacatgtattctgaaaccgtaaattaatatttcctgattggctatccatcttttagatttagtgaccattggcaaccctccctatttcaccataggcaaaggtttgtgccaacacgttcactaggttcacagaagttgaagtattttggctacctgtccgggacataacagtaaaacaaacaaaaattatttgtgctgtcatccttgtggatggaaatagtaaattaaataaacatgttggtaaactaaatatatgatgtatgtttaaatagtgaatatatgttgatacatcttagaaaaacagggaaaggagaaaggcatgtatgcatgtgggggcaggaaaggcattatgaagaaggtggtatttgaataaacacctcaaggaggtaaagaattgggccaagtggctctttgaggatagagggaataatgaaccctggggtgatagggttcctaccatgattaaagaacaggaaggagggcagtgtgactggacgagtgttaaggaaggggagagttttaatagataaagtcagagaggttatggggaccagatcacattctcaaagactgggaaggttctgagactttcacctactggctagctaacttactagcctgcaacttctcttcttttccttttaatttcaacttgtattttaggtccaagggtacatgtgcaagtttgttatatgggtaaagtgcatgatgctgaggtttggcgtacaattgatcccatcacccaagtagtaagcatagtacccaataggtagtttttcagcccttgtgcccctccctccctaccccctctagtagaccccagtgcctattgttcccatctttatatctgtttgtactcagtgtttagttcctacctataagtgagaacaggtggtatttggttttctgctcctgtattaatttgcttacgataatggcctccagctgtatctatgtgcttgcaacattttcaatgatgctagtaagagacatgaaactccagagacaaaggaaagtttattacagcattagcagtagccaaagtatcagcattttttactcaattctatgaacctcagttctctcacggaccacgttataaacatgcattgggttgcttggggaggaagtctgaggttagagatccaaatatttttataatgggcagtgagcatgcttgctttttgctccaaatgaagacagtatctccatcttataaggcagtaagcaaactggcttcttgctccaaaggaagacattatccctgtcttccaagaatattttctacacaaacatatttgaaaagatagccaagaacaaaaacagccagtacctttaatcagcaggtggaggcaattgtcctaagcaaattaacacagaaacagaaaaccaaatactgtgtgttctcataagtgggagctaaacattggatacacatggacataaagatgggaacaattgacactgggaactacaaaatcgggacgaggcagatgggagtaagggttgaaaaactatattgagtactatgctcactacctgggtgactgggttcaattgtacctccaaccttagaatcatgcagcacactcttgtaacaaacctgcacatgtacctcctgaatctaaaataaaagttgaaaaaaaacttgtgtagaaacatgacagaccagtagaaaattgtctctctacatattatggctattacatccatcaagactgtcttataagaatgagatgggaaatcattggaaagctttgagcagaggagtgtcatcatctgatggaagttaaacaatatcgctttggttgctgcactgagaatacagtgacgaatgcaaatgtgggaacagggcactccctatcaagaggttattactataatactggtaagaagtgatggtggcttgtatcagagaagtagcagtggaggtagtgaaaagtcatatttcaaatatattttgaaaaattgaaagatcacatgtgggtaagaaagaaggagaggaatcaagggtaactatggggtttttgtcctgagaaactagaaggataatgttgtcattaactgaaatggggaagactgtgggagaagcaggtattttggagaagatgtggagctcaggtaggacacatttgagatgtttttaagatgttcaaggtggtggtttagtaggctgatgtatgatctagaatttagtaactaatagatcaagcaacagagatcggtaaggaatttaggagatttaaacaacacaatcaacatgtttgatatcatggacatagacatagcatttgaccttcccaatatgcattcttgtcaaaaacacacaaaatatatacaaatatttgctaaatactgggccataaaacaagcctcaaaaatacaaaagaattgatattatatttacatttacagacttgctcaaagctatgattcagaggaaaaacatgcttactctgcctgtgcatcagtagcaggtagcacgaggccttacattgctcagtttaatttgtacctttgaagcttttgttttgttttggtttctctgtctacaccacgtttgctgtgtctgagtttacttttgagttgctttaaaaaatcattttgtgcaatggaaacaatggcggtttgagtgttgagggtgcttataagaggtgtgtaataatggaaatataattttttataactcactttgaaacaattttgaacttatagataagttgccataacaaaaagaactctcatctctttcacccagactctccaattgttcctattttattgcattttctcatctttttcgttctctcatttcctgtctctgtcttcctgtgtctctgtctgtctctgtcacacacacacacacacacacaccctacttattattagacctttttcccaacctataaaaacaagctaaagatgcagtgtcctacaacttctaaacattctagtcaatgtttcccgtaaacaaggatattttcctatataattagcactcaaacctccaaatcaggagtcaacattgatacaacactacaatccaacaatccaatccataggcatgattcacgtttcaactgttccaacaaggtctctttttcctttcttgtccaggatgcccttcaggaatgcgttacatttagttgtcatgtctcttcatatttcttcaatctggaacagttcctcttactgttttccatattcttgacagtttttaagaggctttacatcctgtagaatgaccctcaacttagctctatctggtgtgtctgcacgatcgattcaaaccatgtaatctttgtagaaatgacgtgcacatcaagagctacataatgtagacccgtatcactacagttaatactaaacttgattattgagcagatgatcaaatatacaaataggagcaatatttggatttgccaggtttcttcacttaaaattctgtgttttcccatttgtcaattttggcttttgttgccattgcttttggtgttttagacgtgaagtccttgcccatgcctatgtcctgaatggtattgcctaggtttttcttctagggtttttatggttttaggtctaacgtttaagtctttaatccatcttgaattaatttttgtataaggtgtaaggaagtgatccagtttcagctttctacatatgactagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttctggcttaggattgacttggcgatgcgggctcttttttggttccatatgaactttaaagtagttttttccaattttgtgaagaaagtcattggtagcttgatggggatggcattgaatctataaattaccttgggcagtacggccattttcacgatattgattcttcctgcccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataggaatgcttgtgatttttatacgttgattttgtatcctgagactttgctgaagttgcttatcagcttaaggagattttgggctgagacaatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcaggatgatattggctgtgggtttgtcatagatagctcttatgattttgagatacatcccatcaatacctaatttattgagagtttttagcatgaagtgttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgttggatttggttttccagtattttattgaggatttttgcatcaatgttcgtcaaggatattggtctaaaattctcttttttggttgtgtccctgcccggctttggtatcaggatgatgctggcctcataaaatgggttagggaggattccctctttttctattgattggaatagtttcagaaggaatggtaccagttcctccttatacctctggtagaatttggctgtgaatccatctggtcctggactctttttggttggtaagctaattaaagtgaagagcttctgcacagcaaaagaaactaccatcagagtgaagaggcaacctacaaaatgggagaaaattttcgcaacctactcatctgactaagggctaatatccagaatctacaatgaactcaaacaaatttacaagaaaaaaacaaacaaccccatcaaaaagtgggtgaaggacatgaacagacacttctcaaaagaagacatttatgcagccaaaaaaacacataaagaaatgctcaccatcactggccatcagagaaatgcaaatcaaaaccacaatgagatatcatctcacaccagttagaatggtaatcattaaaaagtcaggaaacaacaggtgctggagaggatgtggagaaataggaacacttttacactgttggtgggactgtaaagtagttcaacccttgtggaagtcagtgtggagattccttagggaactagaactagaaataccatttgacccagccatgccattactgggtatatacccaaaggactataaatcatgctgctgtaaagacacatgcacacgtatgtttattgtgacactattcacaatagcaaagacttggaaccaacacaaatgtccaacaatgatagactggattaagaaaatgtggcacatatacaccatggaatactatgcagccatgaaaaatgatgagttcatgtcctttgtagggacatggatgaaattggaaatcatcattctcagtaaactatcgcaagaacaaaaaaccaaacaccccatattctcactcataggtggggattgaacaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtataattataaaaaaaatacatacagacatatatacacacataaaaaaaattctccattttcccttgtaattcatttctacgtcaggcaaaagtattcaaaaattatatccatatcctgatcctcaactaatctccacccactagcagcattaactttcatcgatgactccagcaggaattaactaccttttggagatcgttgctacatactgattatctacttacatcattcgtgttacgtttattagctggaattccactaataaataaatgtatggaagatctttcctttttctcatcctccttcatttcctctttcatttttccctgcctccctccttcctcccctcctttctatcggtatggtatcattatttttatttaatggattgtaatctattatcataattgttttgtttatcaaattctccctgatttggccagctagagctccttcaagctggttcctgtgtcctcctgtctcaggttatttttctagaagcagactctgggatggaacttagtgtatgggaggtttattggagagtgtgcttggaagcaacatgtgtgagggagaaaacagcaagagggagaagttggcagctgatttcacagggagctctggagctccctggagctctttagagtcatttcacattgaagcaaagtggccaggtctttggagcacccctctcttcctgtcatcttctctttaaacagttattggattaaagctgtcactggtgaggtggtgtaaccttggacaaggcagctctcttcagtcctcgtgagggacttacctttgaactctctgttggcaatattcccaaaagttgaggaagtgagtacctccatttagaaaggggtggggtgcagatctgcattatgtaccataacattcacttcaaggaaattcaacattgaccttgctactattttactttatgaattaaaaagtaaacttattccccccacccccaagacagagtcttgctctgtctcctaggctggaatgcagtggtgtgatcttggctcactgcaacctctacatcctgcgttcaagcaattctcctgcctcagcctcctgagtagctgggattacaggtgcatgccaccacgcccagctattttttttttttttttttttagtagagacggggttttgccatgttagccaggctggtctcgaactcctgacctcgtgatccacccacctcagcctcccaaagtgctgggattacaggtgtgagccaccatgcccggcagaaagtattaattttcttatttatagcacttaagattacatgaaaatattcagcacttttggaaccacaaaaattccaaaaagataatgtgtataacgaagtgtagtcctaattaggttgaaatgctatattccagatgttaattaagaccctgatatggtttggctgtgtccccacccaagtctcatcttgaattccacatgttatgggaggaacccagtgggaggtgattgagtcatgggggcaggtctttcctgtgctgttctgatagtgaataagtctcacgagatctgatggttttaaaatgggagtttcactgcagaagctctcttctctttgcttgccaccatccatgtaagacgtgacttgctcctccttgccttctgccatgattgtgaggcctctccagccatgtggaactgtaagtccattaaacctctttttcttcccagttccaggtgtgtctttatcagcagcatgaaaatggactaatacagatcctgacttttgttttcaaaacactttgcttgaagagctgaatataagttggcacctcccatttctctcacctggtttgaaattcttataataaagctatgtgtttaaaaatgtcagtgtctcatgttcctagataagggatggatctattttaaagatgagatagatgaagaactatttagaatggattctgtgttttgaaacaatgcatagatagttgatacttttattgttatgtgcattaaggttttacagcttgagtactgaaaattctgatgccttttgggtgtgaatgggtctgcctctagaagcagagagaagccacaaataggacttcacagaaaccacaaataggattcaaaggactctgatttagtaagtagcatctatcatcattaaattagctgctcaacgtttcctctgttgttcattttgaggtagaatttgggaaaggtccagggttttcagtgactcataccaagtttttctggcagtgaatcatctttgggagactttagaaatccatataggttaattaagaataaaacgccacaactgctcttcttggataactgatctactgagttctggccaatagcttcagggatggtcagagtaaggggctgtttcagaagcgttagtggttagttttctgagaggaataataactaataattcaagttacttctaaattacacaaacttcactcatgatcaccacttttatggtctttattataaatagaatccctcagagagattaataatatttatatttactcctgtttaacaagtgcagcattaactggccaataccatctagtaaaaaagaaaatagaataggctgattagtgaagtggaaacacttggattgcaatgaagtaccatctgatttatgaaatccatagatttctaaaacaatattttgagtaaagatatgtgttctcaaaacacttaaggataaatgatatggaatatcaaaggaagatgtttttaatatgagcaaaagattgcttcagggagagcacagactggcataatatcaaagatcaagaaaaagattcaaggatttgtcacaatttattgaaagggctgaacttggtaggagtcagccaataagtagcttgattttcccctgtgattcccctttggagatgtctgtgagatctttcattctcatccttgatggtaccttgggtaaatttgttagatctgttgtcattttcaggtttcagtgaaaagttcccattttcaggtactaagagaccccgttcaatctgaatcaaactgtcaacatttcacctaattctaagctccaatcctttttccacagctcatctgactcaaatttagaaagctgtactagggtagtcagggtagtcgtatgtttttgttttgctgtttgtactggtccttaccctccttcttcactttccgttctgctggttttggcttttccaagatcacaatgaggataagtgctaagaagacaagagaagggtcttttttgtctgctgctatttgtggctctttatcagcagtctaatatcttctgtcgtggcagacactctttggatctttgaaacctctttaactcttcacttgtacatctgtcctgcagttcttgacaaggctgatgcttcttggcagaccatttatgaatccaaatcagcttttgctcttgtgggaggcctccagcacatttcctcttgagacaacttacctttctggtcaaggtttttttttaaggtgactcatgcctgcttatcttggtgtgcacctctgttccccagctgctatacctctggctttgcttttagggaaagctacagccagcctcttggctttaagctactttggatgtgggtcaggcactggtcttaagtcttctgtcactccagggacataggtctgactctgagatcttgttctctcatgctccactcctgtttcacagccaatgtcagctcagcagaaattgacaaccccagaaaggaaatcttaggctttccttgtggcaagagcctttactttctttgagtacattttgattcctttctcactcattttttgagtacatcctaacccctcttcctatgccaataatgctcttcaagaaaacccaaaaaacaaaaaccccttttttcagaaccagttctcttagatactacccctaccccacaatataggctgggagcaaatgatggaccaatggtaccatctcttggcatactctatctggattatctatcagttcttttcactcagcataatgcccttgagatcctgattcaatacatgcctgattcatttctttttatttctgagcagtattccatgggacaattctataagatttgattaaccattcatccattgaaggacatttgggtagtttttaggatttggctattataataattctgctgagaccatttgtgtatgtgattttgtgtggacgtaagttttcttttttttttctgtataaatgtccagcaatgtgattgcagggttgtatggttaatgtatgttttgttttataagaaactgccatacttttttctatagcggctataccatcttacattctaaccaacaatatgtgagggatctagtttctctatatccctgccagcatttggcattgtcattattttttaattttaggtgttccagtagatgcatagtgatatctcattattcataaactgtttttagacttgtgggtatacattatacttattattaactttgaggccttggcctgaacttttagacaacaggaaaaatttaatatctcattgcacagtgattcagacaacctctgacttagggtaagattttccaggaaggaattagaattctaattagaattcaaatatagtttggcaggtgtatcagcttgcacctaagtaatatcttctgttgtgttttatatttgttgggcatgtctggtagaatggtgatgtctgccagaaatctacttacatttaagacttagaagtttcctaggagattactcatatcaaagaaatagttttgcagacaggtttgcctagtaaccaagcattcaagttgtcagatggaaggacagggcaatttttgtgagctgcatgatatttgccagttagattggtttgctaatttgatgcaccgtttgtctccaaaactatatccagattcagcataggaaagtagaggagactacaattaaagatactagaagagtcattcttactaagattctgggagacattgagtttaaagaagaacatttgagtattcttcaaagcaagcacaatctaaaaaggaagagaaatctccacacttctgccaaaaacaaccaaccaaacaaacaaaataaacagttgaactctggcactttgatgtctctagcagtaatgggtgaggtccctgacaggagggttgtctggagccaccaggttgcaatttgaggcagcagtagtgagggaaatggtatgagaagatttgtagatgttatgaggcagcatcttttgtgacatattttctcattttaggttttgaaaatagtgaagtactccctgaaaacacacaccaaataatgaactataaaaatacttggattatgaatatattttagtggcttctcttttctttttattataatgtatttttttctcatgcatactccatatcttgcttgtgttcaagcatactttaatttttaattcatcagttaagctgtctttgagttaccatgatattgggcatacctcattattttttacaccaaatgcattttaaaaaggaaaaaggacactgttttatcttctttcttgctgctttaatgaggatggagggataagttacaggctggcacattaaatgtactactatggaaggacctttttctttatcagtgtcccttccctacccttaaaatcactgatcagggtctagcagtatctgctcctcaaaacttgggaccaagtgatggtgttcccacttgcaatgtcctctcatagcacttttaactttcttctatagtttttaatgctttatgcaatactggtcagaagggcttctttctttcttttttttttttttctgagacagagttctgctctgtcacccatgttggagtgcagtggcgcaatcttggctcactgcaacctctgcctcctgggttcaagcgattctcctgcctcagcctcccgagtagctgggattacgggcgcccaccactacacccggctaatttttgtgtttttagtagagacggggtttccccatgttggccaagctggtctcgaactcctgacctcaggtgatttgcccgccttggcctcccaaagtgctgagattacaggcatgagccactgcgcccggccagatgggcttcttttaaaataaatccaatagttgacttttgtttccagcagtatagtagattagataacatgatttacctcatctccatcatgaaaaccaccaaaaatgttggataaattatttgaaaacatcttttccaataaattgatgacctggcaagaaaaaagaatattcagatgccaaaaaaggtgaaaaaagaaaatagaagctaaatagataagtagaatgataaagccagctttttcctcgagcatatttgccaaatctgctaaatccaaagtttaatcttcaactgttcaaggacatgtggacaagagagaagcctagaaatcacttcatatgtaaaaggaggctttccaccaaaaaactggaaccctaaagatacactcagtgaaagggtgaattagaaataaatcaccattattgccacagacacacaggaagaatgctatgttaatacgagggcagagattggagtgatgcacctataggcaagggaatgtttggagctaccaaaagctgaaagaggaaaagaagaaactgcctctagaggcttcaaacgaacatggccctgccaacaacttgaattcagacttcagttgcaacaactgaagtcaaggggacaatgagatcttcaatgtgttgtgagaaaataactgtcaacacactttcacagtcaaaaacaaactttcaagtaaaagagcaaaatgcctattcacataaagagtaatagatgatatgtctctaacaaacactaaggaaattttaaagaatgtacttcatacagaaagaaagtgatttagatggatgttggatggtcttattatattttcaaagaaacaaagaccaaaatagtttaaaaatgtatattatggactaaatatttctgtcttcccaaatacatatgttgaagccctaatccccagtgtgacagtatttggagataagacttttactgaagtaattaaggttaaatgaggttgtgatgttggagttgtaatccagtagaattagtatccttataagaagaaacaccacagagcatgctctctctctgtgtgtaccatgtgaggacacaggtagagccagctgtctacaagccaggaagagagcccttgctggaacctaaccattctggcacactgctcttagactttcagcctccagactgtgagaaatacatttttattgcttgagccacccagtctgtggtattttgagatactttccatcagtacctagtttattgggagtttttagcatgaaggagtgttgaattttgtcaaaggccttttctgcatctattgagataatcatgtggtttctgttattggttctgtttatgtgatggattatgtttattgatttgcatatgttgaaccaaccttgtatcccagggatgaagccgacttgatcatggtggataagtttttgatgtgctgccggatttagtttgccagtattttattgaggatttttgcatcaatgttcatcagggatattggtctaaaattctctttttttggttgtgtctctgccaggctttggtatcaggatgatactggcctcataaaatgagttacaaaggaggccctctttttctattgattggagtagtttcagaaggaacagtaccagctcctctttgtacctctggtagaatttggctgtgaattcatctggtcctcggctgtttttggttggtagtctattaattgctgcctcaattttagaacttgttattggtctattcgtggactcaacttcttcctggtttagtcttgggagggtgtatgtgtccaggaattcatccatttcttctacatttttccagtttatttgcatagaggtgcttatagtattctctgatggtagtttgtatttctgtgggatcagtggtgatatcccctttatcattttttactgtgtctatttgattcttctcttttttttcttagtctggctagtctggctagcaatctatctattttgttaatcttttcaaaaagccagctcctgggacttattgatttgttgaagggttttctgtgtctctatctccttcagttctgctctgatcttagttgtttcttgtcttctgctagcttttgaattttgttttctcttgcttctcctgttcttttaattgtgatgttcgggtgatgattttacatcttttccactttctcctgtgggcatttagtgctataaatttccctctaaacactgctttagctgtgtcctaaagattctggtacacaaacacaaaaagattgtgtctttgttctcactggtttcaaagaacttatttatttctgccttaatttcattatttacccagtagccaattgggagcaggttgttgagtttccacacagttgtgtggttttgagtgagtttcttaacactgagttctaatttgattgcactgtggtctgagagactgcttgttaagatttccatcttttgcatttgctgaggagtgttttacttccaattatgcggtcaattttagaataaatgcgatgtggtgctgagaagaatgtatattctgttgatttggggtaaagagttctgtagatgtctattaggtcctcttgctccagagctaagttcaagtcctgaatatccttgtttattttctgtcttgttgatctgtctaatattgacagtggggtgttaaagtctgccattattattgtgtgggagtctgagtctctttgcagggctctaagaacttgttatatgaatctgagtggtcctgcattgggtgtataaatacttaggatagttagctcttcttgttggattgatccctttaccattatgtaatgtccttttttttgtcttttttgacctttgttggtttcaagtctgttttatcagagactaggattgcaacctctgcttatttttgctttccatttgcttggtaaatgttccttcatccctttattttgagcctatgtgtgtctttgcacatgagatgtgtctcctgaatacagcacaccgagggttcttgactctttatccaatttgccagtctgtgtcttttaattggggcatttagcacatttacatttaaggttaatattgttatttgtgaatttgatcctgtcattatgatgctagctggttattttgcccgttagttgatgcagtttcttcatagtgtcactgatcttaataatttggtatgtttttgcagttggtggtacctgtttttcttttccacatttagtgcttccttcaggagctttggtaaaggcaggcctggtggtgacacaatctctcagcatgatactggacaaaagtcatctgtggatggacacttaggttgattatactacaagactacagtaactgagacagcatggtactggtacaaaagtcatctgttgatggacagttaggttggttccatatctttgctattgttgaaccaactttgcatcctggggataaagcctacttgattttggtggacaagctttttgatgtgctgctggacttggtttgccagtgcttttttgaggatttttgcatcaatgtttatcaaggatattggcttaaagttttcttttttgttgtatctctgccagattttggtaccaggataatgctggtctcatagaatgagttaaggaggagtccctcctcatcaattttttggaatagttttagtaggaacggtatcagctcttctttgtacatctggtagaattcagctgtgaatctgtctggtcctgggctttttttggttggtaggctagttattattgatttaattttggagctcattattggtcttttcagggattcaggttctttctggttcagtcttgggtgggtgtatgtatccaggaatttatctatttttcctagattttcaaatttgtgtgcatagaagtgtttacaatattctctgatgattatttgtatttctgtggagttagtggtaatatcccccttgttatttctaattgtgtttatttggatcttctctcttttcttctttattggtctagctagtggtctattttattttattttttcaaaaacacaactcctggatttgttgatcttttgaatgattttttgtgtctcaatctccttcagttcagctctgattttggttatttctttcttctgctagctttgggcttgatttgctcttggttctctagttcttttagttgtgatgttaggttgttaaattgctatctttctaactttttgatatgggtgttcagtgctgtaaattatcctcttgacactgtcttagctgtgtcccagagatcctggtgtgttgtatctttgttctcattagtttcaaagaacttcttgatttctatgttaatttcattgtttaccccagagtcattcaggaacaggatattcaatttccatgtaattgtatgattttgagctatttccttagtcttgatttcttacttcattgcactgtgatctgacagagtggttgttatgatttcagttcttttgcatttgctgaggagtatcttatgtctgattatgtggtcaattttagagtgtgtgccatgtgacaatgagaagaatgtatattttgttgtttttgggtggagagttctgtagatgtctgtcacgtatgtttgatccagtactgagtttaggtcctgaatatctttgttaattttctgccttgatgatctgtctacagatgctcccattccaaaccctctgggctctgtatcggctgatatccttccccatcacttctccaagcaggttttcctgccaactcaagtgtctgtggtggtcaaggggtctcctgctgccaggattccagaggcctgtggtgagagtgggttgttccttgccagttcaactcacccattcccccagagtcactgggggtcaggaacaagtactggtgcatagtagccccctccaggggtcccaacttcctccctcttcagcctggcttctgtgtcttccctcagtctgctctcagtgccttccctctgaagatctgctaggactgtgtgccacttgtcctagtcccttggtgacagctgttccacctggctgtgtctggttggccatcttgcccaaatctctcaataattttaaatgacctgatttcaagtttgccaattccttctcctgtcagatcaagtctgctgttaaacccctataatgaattgttcagttcagtttttgtatttttctgctataggtttctgttttttaatatagtttatttatctttgttgacagtcttattttgttcatgcataattttcctgatttctttagttgcctatgttatctttttaacatattgagatccttgtgacagttatttaaaatccttgttaagcagctcatatatctgcattcgttagggttgatttctggagttttattttgtccctttgatttagtcatgttctgctgtttctttgtatgccttgtaattttttgcttgggtttgagcatttgaaaaataccctctatcccagtttttatattctgactttgtacaggagaagaccttctttaatcagcccagctggaagacctctcaaacccttctaatctcttactctccttggaatctgcctgctgaactgcatttctaatattccactccacctttgtttccagtggcttctgaattctggtgtcaatactgtcagcactctgagtcaggtggtacagaaatgagtcctttgggcagccctcagacaagccagaacattggactcatgttctactgtttatttctgtcccaagggaggagaactcatatagaggattccttccagttgctctgtgtgatgctgcatagaggaaggggaacaaatgtgtgtgacaaatgccgcagattttcctacacctttcactggaattccgtctttgtcttacaatagccttagtgctatagattctcaattggtctccagcattatcacagaggaattgtggtccacatattattgttaatttggtgtctttgttggggaaggagagcctgtagcttcctagtctatctatgctgacctgcacttctacttttaaagtgtaactttttcctccaaatctaaagctctgcaatatgctttgtgaatttcaccactcttaccttggatgcactaattttgattatttcagcacatctatttaatcactttaagttgaacaattcctactgatggttatttgctaccaaatcatcctgttcttggtggtgtacctcaagatttctaaaatagattaattcccagagcgttgttctttaagatggactcaaagcttagtctatgtcataaacaggtctttatctgtacatactataaggctatgagtttaaatggataatctttgcagataaaattaactttgttcttaccaaattgcaggattcttaattaaaatactttcatttcattttgtttaataaaaaacattttgactttagccacagctcttctactgtaccataggcattttctgttcagttagcagagaaaaagaggtaagaataatttaagactttttgtagcatgtattaatctattatttgccttttggtctatggataagtgcatatgattttatgttggcttgtaagctcttctttaaagctttatcacaataagaatctaatagattaaaaagaacttttcttccatccttaactatttgaagtgttacgactttacctctccatttcaatttaagcagtctgacaaattttaaattaactaggtacacacctagttactgtagcaaaaatgaaagctgagcatctttctttgctgaaggaatggattattgtcagagtccactgggagttgtgtgaatgagcaattaaacctgttgtctaattgctaacagaaggaatggttaagtatcaattatagaaaaaataaaatcatccctttaggcacactttcctcaggactcagatggataatgctgaacaactctacttaacagtttaagtcatttagttatttgggtggctattttgttctgaatgatctttggaaacccatcaggatgatgtgttgcttaaaaattaagcattttacaaaatcgcatgattgttttatgataggcaaagacatctggtgactcctgctaccaaaatcttctaggatgtggtgttctattccatgttttgtgaagcacaatttgggggttgaacagatgccaaggtaaactttaaaatttttgcaataaaacatcgagtttgtcaactataaatctagaaaataaagcatatagtgatcctttcaatcaataactaggatacctggacttctacagggactttaagttttaattttttgactattttctggctgacacaattgatatccaagagtaaccatctaatgagtgttaaataatttctcccttagataattcactattattctagtaacatgccagatcattagcaagctactatattaacttagcttatgacaatatatttatagtactatgaatattatgcctataatattattacagcctttattgtgtgtcagtataagaaatggccatctatatagagtctcttcattttctagaaaattgtcctccaagataacataattgtttaatttcttttttttttttttttgagagggagtctcactctgtcacccaggctggagtgcagtggcgcaatctcggctcactgcaagctctgcctcccaggttcacaccattctcctgcctcagcctccccagcagctgggactacaggcacccaccaccatgcctggctaatttttttttgtatttttagtagagacggggtttcaccgtgttacccaggatggtctcgatctcctgacctcgtgatcctcctgcctcggcctcccaaagtgctgggattacaggtgtgagccaccgcgcctgcccttaattgcttttcttaaattgaagtttgctcaatacatttttattagagttcagtaccaggacgtagtgctctgtttttggtgtgatggctggaatgttttcttttattgagtagcaacctgttgtatgttatattttgcttagacttcccagaaacccaaagctagttttatgtgcagtcgtttgtcatgttttagactagtcttgtttggtcttttttgatttttttcttcctgtcccttcttaatttttccattttcttttcttttcttggtaagagggcatattttctttttctgtcagtatcttggctactaaaaaatatgtgtgtgtatgtgtgtgtgtgtatatatatatatatatatatatatatgtatatatattttttacagtgagctctcttttatgctattcttatgctatttggaagtgtcataataatattaagctgggtaaattgtataggaagatttatggatgttttaggagtctcaaaggcttatttacagaaggttttggcagattccattgattatgtacatgtgtcatctaggtttttaaattttgaataatcatcatccaattcagaaatgttgagacccatctatttggaaggcatatgttttagctcagtaaacaagtcctggagatttttaaatctagattttaaaaaaaatcttctgtattagtctattttcacactgctatatgggaagcaaggaccttcttcacatagtggcaggagagagaagcacagaggaggaacttccaaacacttatattaataaaaccatcagatctcatgagaactcactcattatcataagaatagcatggggaaaactgccccacatgatccaatcccctccctccctctagatgttgggattacaatccctcccttgatacatgggagttacaatttgagatgagatttgagtggagacagagagctaaaccatatcatcttttcttctgctctcactggtattttaataattcagaccttatctgctagaaatgtttttttcagatgaaggggtttacttatatatgcaagtccacccttccattcctcctcatgcttttctgaagtggttctcaccttaggaaagctatctccttctctcatgagtctactcaagtcttacccatcctttgaaacctaattaattctatcactttctaatgcccatttaggtccaactagcagaaataatgcatttatcatgtcactgatctggcaattaaagcattcaatatcttaggatatttcttactctttttccctgaacttttatctaaattatatactcacatttaatttttacaaacttttgcctggtcttaacctaaatagttagctctttgaatggagggacactattttatttatttatttatttttattattatactttaagttctagggtacatgtgcacaacatgcaggtttgttacataggtatacatgtgtgatgttggtttgctgcacccatctacttgtcgtttacattaggtatttctctgaacactatccctcccccagccccccactccacaacagggcccagtgtgtgatgttccccaccctatgtccatgtgttctcattgttcagctcccacttatgagtgagaacatgtggtgtttggttttctgtccttgtgatattttcctgagaatgctggtttccagcttcatccatgtccctgcaaaggacatgaactcatcctttttatggctgcatagtattccatggcatatatgtgccacattttctttatccagtctatcattgatgggcatttgggtttgttccaagtctttgctattgtgaatagtgccacaataaacatacgtgtgcatgtgtctttatagtagcatgatttataatcctttgggtatatacccagaaatgggattgctgggtcaaatggtatttctagttctagattcttaaggaatggccacactgtcttctacaatggttgaactaatttacactcccaccaacagtgtaaaggcattcctatttctccatcctctccagcacctgttgtttcctgactttttaatgatcaccattctaactggtgtgagatggtatctcattgtgatttttatttgcatttctctgatgatcagtgatgatgagcatgtttttatatgtctgttggctgcataaatgtcttcttttatgaagtgtctgttcatttcctttgcccactttttgatggggttgtttgtttttttcttgtaaatttgtttcagttatttgtagatcctggatatttgccgtttttcagatggatagattgacaaaattttctcccattctgtaggttgcctgttcactctgatgatagtttcttttgccgtgcagaaactctttagtttacttagatcccacttgtcaattttggcttttgttgccattgcttttggtgttttagttatgaagtctttgcccatgcctatatcctgtttaatccatcttgaaataatttttgtataggtctaagaaagggatccagtttcagctttctacatgtggctagccagttttcccagaaccatttattaaatagggaatcctttccccattgcttgtttttgtcaggtttgtcaaagatcagatggctgtagatgtgtggtgttatttctgaggcctctgttctgttctattggtctgtctctctgttttggtaccagtaccatgctgttttggttactgtagccttgtagtccagtttgaagtcaggtagtgtgatgcctccagctttgttctttttgcttaggattgtcctggctatacgagctcttttttggttccctatgatatttaaagtagtttttttccaatgctgtgaagaaagtctttggtagcttcatggggatagcattgagtccataaattaccttgggcagtatggccattttcacaataatgattcttcctacccatgagcatggaatgttcttccatttgtttgtgtgtcctctcttatttccttgagcagtggtttgtagttctccttgaagaggtccttcacatcccttgtaaattgtattcctaggtattttattctctttgcggcaactgtgaatgggagttcactcatgatttggctgtttgtctattattggtgtataggaatgcttgtgatttttgcacattgatcttgtatcctgagactttgcttaagttgcttatcagcttaaggagattttgggctgagacaatggggttttctaaatatataatcatgtcatctgcaaacagagacaatttgacttcctcttttcctaattgaatacctttatttctttctcttgcctgattgccctggccagaacttccaatattattttaacaggagtggtgagagagagcatccttgtcttgtgccggttttcaaagggaatgcttccagtttttgcccattcagtatgatattgtctgtgggtttgtcataaatagctcttattattttgagatatgttccatcaatacctagtttattaagagtttttagcatgaaagacttgaattttgtcaaaggccttttctgcatcttttgagatattcatgtggttttggtcattggttctgtttatgtgatggtttacgtttattgatttgcatatgttgaaccagccttgcattccagggatgaagccaacttgatcatggtggataagctttttgatatgctcctggatttagtttgccagtattttattgaggatttttgtatcaatgttcatcagggatattggcctaaaattctcttttttgttgtgtctctgccaggctttggtatcaggatgatgctgccctcataaagtgagttagggagtgttgtgggaagtcaggaccccaaacggagggactggctggagccacggcagaggaacataaattgtgaagatttcattttaatatggacatctatcagttccccaaattaatatttttataatttcttgcacttgtctttactgcaatctctgaacataaattatgaaggtttcatggacatttatcagtttccaaaattaatacttttataatttcttatccctgtctttaatctcttaatcctgttgtctttgtaagctgagaatgtacatcacctcaggaccactattgtgttaaactgtacaaattgatcgtaaaacatgtgtgtttgaacaatatgaaatcagtgcaccttgaaaaagaacagaataacagcaattttagggaacaagggaagacaatcataaggtctgactgcctgcagggtccggcagaatagagccatatttttcttcttgcagagagcctgtaaacagatgtgcaagtagggaagatattgctgaattcttttcctagcaaggaatgttgataattaagaccctgggaaaggcacgcattcttggggggaggtctataaatggccgctctggcagtgtctgtgttatgcggttgacataaggactgaaagatgccctggtttcctgcagtaccctcaggcttactagggtggggaagaaaccccaccctggtaaatttgaggtctgactggttctctgctctgaaaccctgttttctgttgtttaagatgtttattaagacagtacttgcacagctgaacatagacccttatcaggagtttttgactttgccctttgccttgtgatcttgctttgccctttgccttgtgatctttattggcctcagaagcatgtgatctttgtgacctactccctgttcatacaccccctctgcttttgaaatccttaataaaaacttgctggttttgtggctcaggtgggcatcacacacctaccaatatgtgatgtcacccccagtggcccagctgtaaaattcctctctttgtactctttctctttatttctcagaacaactgacacttagggaaaatagaaagaacctacgttgaaatattgggggtgggttcccctgataagggaggattccagaaggacactattttatactgctttggatctcttcgtattgcctgagtaggttctccacaaatattatttaaaatttaacaatttgctattactctattgagaatgagtttctttgtttgtttgttttctatttagatacagggtctcattctgtcatccaagttggagtgcagtggcatgatcacagctcactgtgaccttgaattgtggacccaagcattcctcctgcttcagcctcctgagtagctaggactacaggcatgcacgaacacacctggctaattattctattttttttgtagagatgaggattttgctatgttgcccaggctggtctagaactcctagcctcaaacagtcctcctgccttggcctcccaaagtgctaggatcacaggcatgagctactgcacctggctgagtattgttgttgttgttttaaacattttatttggtcattttggaaacttaatgtctactacatttatcattatagtttgaaaatctttacatcttttatatagaaaacattatctttttaaaataggaggtttaaaatatttcaacttaagaatatattaaagctaacccatattattaaaatgaaaatgataaaaatatctatgtgaacatggcctgcattttacccaaatgtaatctaacactttttttctttctctgtaggaggcgactaatactaatggagttctagttatatgctaggcactgtggaggcctctttattttattgattccttatcatactctttttggaggtatgctagaagagtctttgacaattctacctctcagactatagggctttctttaccatttgccttgtgatattccttggctgctataagaacacggcactagaaggctcgcttttctatttttcttaatgtatactttaaagattttatcaagtggaggaaacgaaataatgagctattttctgatctttgtatcttccactatggtcatgataattttgacttgcttgtcaccagtaatattttaattaaaaactaagggagccttcctcttattgccccaaactggctggatctcatcattgtcaatcatctcagtttaaaagaaggtgggcagacctgcctgaggggaagtagcaaccaagtcctatttgtagaaactgtttgtaaacaaacactatttttgtctgccttcctagaacggggggcagggtatttatgactcagtatataaaacattttgagggaggaaacttcagccattgctaactaaaaattcaatgtatgtattttttgtgcttattaatgctatcttgaatggaaatgaaaaaagaactttattgaaaaaataacctcatagatatgtctcttaaagttcttaacttttcactcactgttttgtaaaaactaataataatttaggacttgacaaaagcagaatgaaatctccccagactttagccaaaatttccccacgaacagagattcttaaatatctccttttcacacatgagaaacctgatgttcaggagagttaagttacttgcccaatgtctaaggttagaaatggaagttgtgtctgtttctctctactaaggcttagctgccacatctattcatttaaatgctcacaaaccttgatgttcatataaacttcagaattattatatacatttcactttctctccgagtttcacttataatttagcaggttgtactgaaaagcatagaagactaaacaagtaaaatgtgtgttcctaggaatcatagccagtgcctacttatcttttactttttatgactattataagttcatagagatagagaatctaatacacatgtaactacacctctattaattatcacagtgggattgaaagtagtgaaataaagcctaaagcttatttttttcctatgaagaaagcatgtgcattgcttgctgtgttccacatggccaaatacacctgaaaaacaagtatttgaaaacaggaaaacacagtaataattcctgacactgccatctactgtgtgttggaccaatttctctattattaggaaaaccaaggacttggctggaaaccatcccatgtgttggaagggcttgaagaattgaacatctccattagtaagaatcagtttcaatggaaatcagggactggttggaccataaagaattgttggcatgagaaaaatgtttaagtagtttgaacatttgcctgtttcatgcaaaatgaccatgtgtgtgggtttctttatcttatggaattagaaatgagtgaaaagaaaattatactatgaatggaaaaaatgtgaaaacaaaaaaggaaacattttcaatatttgctgggttaaaagtaaaaaactcacacattatggaatctaacttgctatatgtcattggtgcacaatagctagaatttagtatttaaactagtccatgaaaaaagcaatttaccaataatatgaggaaaaagtaaactgagaggagattttatgatttaggagaggttatatgtatagttgtaaatcataagttataacaggaaagatagctataacataaatgagcaaataagcaagacttgagtatatgagaaaagtaactggacatattgcctatcttgcaaaatgtgtgaaccagaattcttggtataatattttaatgagtactctggattctaaagtattctaaccaaattgttattttatagaatatcaaggtatatctttggttaactttgtgttagaattctatgtggatgtcacccattttctggcacctttaatgaaatcttctagactttctttctgtaaaatctcattactctgactattccaatatctatgtacatatgtatgtatgtatgtatatctatctatctatctatctatctatctatctatctatctatctatctatctaatcttctatctatacatccattcatctatcttcatctgccctctatataatctatttatatacatccacacacccacacaaattttgggttaatctatctttcaaactttcactgtctgagcctttaagcatcaaaactgtggcttgccctattgttaaattcactagcccttacgttacttgtcatattatttatttccatttctaaaagctattcctttgggagttataaaggtactcatcttggttaatttttgagtactctgcctttcactaaggaactattctatgaaaaccatcataatcagtttttattattgctattaagtttaaatatttaaccgattttttttttttttttgctctgcactatatgatggatgctagatactcaacagacatggtcactgccctcagttctatgaaagacaatcaggaaaggcttccctaaattagcaaggtgaagtgatagcacctggtatggaggagaagatgaaagcattctaggcagagggaagcaacacaaaatctctactccaggaaagagtgtggcatattctaggaattaagaaacacaatttcttaaagatcaagattgatccctaatgtcactatgagagactgatttatgtaagccagatacaaaacttcatctcattatttcataatcacactcttaagacatgattaaacattttttcccataaactactattattctaaccctcaaatgtcttccatttattaacaattttgacttttggacagttaaacctaagtagaatatcaaggaatataggaataaaatgtttgcattaatatatttgataaagtgatctagaaatattatttttttcttacacatatgaatatgatactacaataaaacatccaaataatgcaaaggtggatatagcacaattggtgattgactcctgtactctttttatcccagcctctgtttctaaaatagggaagagagagctaaagcttcatcttctgggtggtgggtgaggcaggatagagaaatagtagatagtccagtctcaggaagctaggatatggcaggtgggtccttatgtccctttattttcctggcttaatctctccaacttccttaactgggagtttcctggattccctaatgctattctggaagtcccagccaggtattaaagagaaggtagctcagatctagaaataccattatcccttagccacagcccagcttgggagcacccagagattgctgagctcttttagaggcactaccataagttgccccagtagttaggacactgttgcttcttactgttactacttgacttggggccatttctcctctctaatttccctctgaagctgatggccttgtgatatttctgacagttttgagtgagatggaaaatacagataggagaggctcccagagatgaagtcttgatctggaactgagttatgaacttaagctcacttgacttaactgcatttagcacaaaacatttagaacatctacacaaaatagagaatttagagttaataaattaaagcaatactaaaagccatattttttgtactactgaattttaagtactagtctatctgtgaagtataatgtcaaatatactagaaaaagaggacagtggatttgaattttattatatgtacttttttacttctcaaaaagaaaactgactttgaagttcctaattttagttatatttgtggacagcaaaatgatttgaaattctgcctcaccttgttcacagtagattccagtggttcctagaggacagaaacaggtgtatccatgaggtaatgaaatgcaggttgctcctctgctacagtggtgtggagggtcatgttcaggatcacaggtagaaactgtctctgtgcagaatgatcctttccacccagtggtacaattgcagctgtgggttgagagaaagccgcatggtttgagcacttgtttagagatggatacatactatgtattgccctgatgctaacttgtcaattttaactgaagttccaagagatcaaaatgaattgtgattcaaaccctaaattgtcaaaggaaagagttaataactggttataggattactggactccacaccaaagactttaaacgattcagagtgtaaaaattgaaagagaattttttgagaattgtttcttcagacaaaattgcattgtaagtctctctcccaactcccacaccaccacctaaagaaaaagctgtgcatggtgttgctgtctcctaacttcaagcctagtgaaaagagattcagcaggaccacttggagagcttggtgtgtttttccctggcattggcaaactcacaggctcagctcctggggttgccaaaagagctgcaaacatactggagacaagtcaaacgtgagtgaatcccaggaaagggatgttcatagtcaggaacaatagcttgaggacatataaaaatgaatcttgaccaagaggtgtccctctagctaaagatacagtggcagtaagtggtttctggctagagcagaagctgaggggtaatggggaatactcagctgaaagagacaccttgtctgggtttagagagtgatattgggaggagcccagcagaaaactttctgatagacccatcaaaggcagagttgtcagataaaatgcagagcatctagttaaatttaaacataagttaaataataacttttcttagtagaagtatgtcctgatatggtttggctgtgtccccacccaaatctcatcttgaattgtagttggcataatccccatgtgttgtgggagggaccaggtggagaaaattgactcatgggggaggtttcccccatcctgttctcatggtaatgagttagttctcatgagatctgatggttttataaggggcttccttcttcaatgggcgctcattcttctccttcctgccaccatgttaggaaggacatgtttgcttccccttccaccatgatgtaagttttctgaggcctccccagccatgctgaactgtgagtcaattaaacctctttcctttataaattacccagtttcaagtatgtctttattagcagcctgagaacggactaatacatgtcccatgcaatatatgaactttaaataaataatatttgagattttattgttatatcttgttatatatatatatatatatatatatatatatttgataaactgttgtttgtcagggcaccgtgtgtttattttgccccctccggcctccctccctccctcactccctgcctgcctttctccctttctccctttcttccttccctttctctccccaccatccccctttctttcttctgaaaacactacactaaagagtacatgagagaaagggttaacttaaaattcctgtcagagccagagagcaataaaccaccgtgccagtctaaaaagcgcattctagaatgggtatgaggtatagggatcagaatctgttaagctggaggacagcagctgatcacaccttcccagaccttttatttatgtcatagacttttatatgcttgttacacctaaattaatagttgtgcaaaaaacggaaaattgtatagggttctctaaaatggagacaaacaaaatacagaattaatctgctacaaaattgcatattttgaagattatttttgaagatcacaaagagtatagaatgtacaaagacctcatacacaaaaaaggaaatcagtaactaatttcacaaaagaaataaaactatagtaaaaattcttattaaagaatttttaaacgtgatgctgtcattactttttaaagtgacgattgcgccatctagtggttcattttatatctacttgaaaaaagcttaaaattattctcactgccttatagacagagctcacaatggtaaaatattttatttaattcacttacactttattgtatatatttaaggtatatagcatagtgttatgggaataaaacacttgcttggatattaaagtagataaatcacattaagcataatttaatatagatgccaaaatcttatttgaaaaaataacaaatcggagcctcatatagtttgtctcagaatttttaggtctgaaacaattagctatatgtttaatatataattagttattatataattctaatgagaatgattttgtgcaaggtcagatttttctttttgttccttggtttctatagcaccctgtgaaatagagataataaaaaaatttcaagccttcattagttattctctactttgggtgatatttttctaacccttgatgttaattcattaatatttcttcccttaaccacatatactactctgccctgaggaggagtagattttgtagaagtatgtgtgtgaggtgaggtgtctatataatgggcaatgtaaaaacaaaacagaggtaggtatctatttaaagaatgtttattattttttacaggctagctgtctgtgcttatcttaggattgagcatagtattgtgcttgatactgagattctacaacacaggaggctccatttttgacctcatggacttctgtattttggagaaatcagattagtaaggagacaattttaataaaatgggacaagttctaaaatgggtattatggtatcctgtggatgggcatctaagtaattttagtgaattacttagggaaggcttaggaaaggccgccagagtgagatttgcccgtataaatgtatgcactgaaaggaggtgtcaaaggactttgaacagcaggctcaggcagttcaacttttttttttttaaaactatttattaacttttgtgggtacatagtaggtgtacatatttctggggtacatgacatgttttggtataggcaggcaatgtgtgatgatcacatcatggaaaatagggtatccataccctcaagcatttatcctttgtgttacaaacaatccaattatacttccttagttattttaaaatgtacaattaaattattattgactatagtcaccctgttgtgctatccaatactagtccttgctcattcattctcactagttttttgtacccattaaccatccccacctccctgttacctaccaccgttctcagcctctagtgaccatccttctgctctctatctccatgagttcaactgttttgatttttagaacccacaaataagtgagaatatgtgatgtttgcctttctgtgcctggcttcagttcaactttcaagtgacatgacaggtgtatagaaaatgacacaaatgaggaggcacattttaagaatattgatctgttatgtgtaggatgactgcatagtgtaacaataagctctctggtgacgtaattttaatcttagtgagatcttagcatattttttttgctactagaaaaggggccagcaacctttttctgtaaagggcaaggcagtttacagttttgctttgtgggccatatagacactgttgcaataaccgaactctgccattgttgaaagcagccacagaaaacacacaaatgggtgtggctgtattccaatgaattttagttacacaaataggtggtaggccagatttggcccatctaccatagttttctgaccccggcactctagaccattaattccgtaagagcagagatagggtctgttttgttttttattattgtctcaaggccccaaacagttcttggtttattgtaagttttcattgactattcatggaataaacacacaaatgaataaatataataggtcatggctgggataagaaagcagatggaggcaaaagtcctgaataggaaaattgctgtggggatgcagaggttgaagtagatgtgagaggcattttcaaggctttggtaagtgtgttagtatgaaagaggaaaaattatagtaatgacaaacattatttgtcacttaccatgtgccaggcagtcttctaacctttctagtttctctattatgttataagaagggtactagcatcatcctcatttttcagagaaggaatctaaggaagagagaggttaagtctgctaatgagcgaggaaatccaccttttagtcaccattttatgtctctcaatcctgtggaaatgttgggaccatgaaagagtatggtgttgttagtgaaatagggacaactggatagcaatatagtaaagggaaaacataaagaatccacttttataagctttattcctgggatggagactggttcaacatacacaaattgataaatttgattcaccacataaatagaattaaaagcaaaaaccatatcatgtcctcaatagatgcagaaaagactttgataaaattcaactttcttttgtgttaaaaaccctcaacaattaggcattgaaggaacatacttcaaaataatgagagcagtctatgacaaatccacagcccaacatcatcctgaacgggtgaaagatcgaaccattccccttgagaactgcaacaagacaaggatgcccactctcaccactcctattcaacacagtaatggaagtgctagcccaagcaatcaggcaagagaaagaagaaaagatatccagatagaaagagaggaattcaagctatctctccttgcagatgatactattctatactgagaaaatcccatggcctctgccaaaaggctcttagaactcataaataacttcagtaaaatttcagaatataaaatcgctgtacaaaaatcagtagcatgcctatacaccaattacatccaaggtgagaaccaaagcaagaatgaaatcccatttacagtagccacaaaaagaataaagtacctaggaatacggaaccaaggaggtgaaagatctttacaatgagaattacaaaacactgataaaggaaatcagagataacacaaacaaatgaaaaaagatttcctgctcatggaaaggaagaatcaatatggttaaaatggctatactgacaaaaacaatttacagattcaatgttattcctatcaaactaccaacataatttttcacagaattaaaatattctaaaattcatatggaaacaaaaaagaggctaaatagctgaaatgatcctaagcaaaaagaacaaggccggagacatcacactccctaacttcaaactatactacaagcctacagtaaccaaaatagcatggcactggtgcagaaacagacacacagaccaatggaactggacagagaacatagaaataaagtcatacacctaaaagcacctgatcttcaacaaagtcaatgataacaagcactggggaaagggcttcctattcgataaatggtgctgggataactggctagccatatgcagaagactgaaactggaccccttcccttcattatatatgttatgaaaattaactcaatatggactaaagactttaagatctaaacctataaaaaccctagaagaaaacctaggaaataccattctggacatcaggcttggtaaagaatttacgactaagtccccagaagcaatttccataaaaacaaaaattgacaagtgggacctaattaaaccaaagagcttctgcacagcaaaagaaactatcaacagagtaaacagacaacctacaaaatgggagaaaatattcacacactacacaacaaaaaaggtctaatgtccagaatctataaggaacttaaacaattcaacaagcagaaaacagacaaccccattaaaaaaatgggcaaatgacatgaacagacacttctcaaaagaagacatacatgaaatcaacaaatagattaagtaatgctcaacatcactaatcgttagagaaatgcaaatcaaaaccacaatgagaaaccaactcacaccaatcagaatggctattataaaatgtaaaaaaaatgacagccattggtgaggttgcaatgaaaagggcacacttacacattgctagtgggaatgtaaattacttcagccattgtggaaagcagtgtggagatttcttaaagaacttagaacgaccattcaacccagcaataccattactggctatatacccaaaggaatataaatcattctatcaaaaagacatatgcatttgtatgttaaccgcagcactatacacaatagcaaagacatggaatcaacctagatgcccatcaacagggtactggataaagagaatgtggtacatatataccatggaatactacacagccattgaaaaaatgaaatcatgtcctttgaagaaacatgaatgcagctggaggccattatcttaagcaaactaacataggaacagaaaaccaaatactgcatattctcatttataagtaggagctgaacaatgagtacatatggacacaaacaaatgggaacgataggcactggggactacttgatgtaggaaggtgggagggaatgtggggtgaaaaactacctattgggtactatgctcactatctgggtgatggaattatttgtacaccaaacctcggcaacacacacttacgtaacaaacctgcacatggacaccctgaacctaaaagaaaagttgaaaaaaaccccacttttagctagactgcattgaaggtaagagtaggtgataaaatagcttttttttttctataagcatctagggacatggctcataaatttgatgatagttcaggacataaggcagatttaattaaatagactagcaggcaaagagctgggacacatgcacctggcatacaatacctaagactacttaaattatactgaggaatcattaacattatacagagcactgttttcttatttcaagaccattcaaaaaatgttatgtatccttaattgtcagtacaaggaaaaatttgtgggttcttctgtctccaaacataaacagatgatagcagagaataaaatgttaaacactttggaaatgtgattaatagctcatcatgatagtaaatcaagagatgaatattagagtatgttcttactaatatagttaattattttacttctgtgcatttagaatgaaactcatttgaattcctaaattgcagataaattgtttagttctgaccgtcaattttatagcttagaacttctatgggttaatttttcctcattactatagaaattcaacatgaagattttaattttcttgtacttaggcaagtctaagactgtaagagtttagtatgaacatggatataaaaaattaactgaaaatgagataatagaagatttaatgttttttgttaaatatcattcacttactaaacattaccaaagagggaatatagagcagcattgtacttcgttaccaaggtgagtacaaaatagaaaacatggtcttgttccccaccctgaggacttgctactttatttagaataatgtatttgtatgaaatatatgatatatataaaatataatattcagtttcttagggctttaccttagtgccaggcaccattttaagtactttgatgtagtacttaatcaaagtttaatcaccatataaaacctacaaagtaaatactattattagctctcagattgcagatgagaagctaatacagaaaaatataatctctgcttagcctactttttcagcttacctatcaaatatggattttgatgctttggacaagagagattcttatgtatatgttgaggctgagataagaacagagaatgaaagttattggagaaaatttaccttgagctggatctgtaaaaaagttctggttatagatttgtgggttttctatgcataagcaaaagcacagacacaaaatctatgtggtgtgatgataaagtcaaatgaataatataataaacgcatgtaatttagcaatgggcgatcacacgacctaaaggaatctagttctgcatatataacttatttctctgctctttaaagaaaaaggaaaacatagctgaattatcttctcaggtcatctcctgtgtggatgacttaattcatataaaattgctttcctttatggcttatttccatttgagtaacaagttgggggaataaggtaagtgtgatatgatgtataacattttacctgccaaaatttgctggattttaaatgacatgctcaaaatttgaagtctttgaagaatatacaatcaagtgttaaaacaaatgaacctcatcgtacactggaatgtgatggcatattgaaactcgacatgtttactaggacgggttgctataataatcactccacctgctgacattcccctatggccttcctttctttgctggtgagatactcacctaggtccttggtgatacctcacagagtgtaagaaggatgagatgaaatgactctttacatactaatgaaaatactggcagttgtctgtaggccttattttgtagttcttcaggtttaagggcttgaacactgtagtatgttaacagttgcactcagaattcctattaaggagagaactgtctttgggaaactacatgagctgcttggagtagacagtggaccctggttgcattgggatgaacatgagcctggactacaaaataagatgataaattactctgcctgagaccaggagggacttgtggtttgttttaacctacagatcagttggaaaaaagcaaagcaaaggacagaagacaaaaactggagtggaattgccatgtatttactgcagtggtggggtgaccaaaagacaagttggaagttatttaggtggccatgatataaacctcttccttcaacattgtcacctctccccaccccctgcaccaatctaaacaatctgatctaaaaatgtaaatggctttgttaatttgatagaaattaaagaagttgattgtagcttttaggcatctgtgatatggaatacacagtatgggtgaaagactggtgagctagagatgactttagaagataaacattccttttggaatcttcacaatttatgtagatgtcaagggtctggtagaaagtaactgacatctgagttataaaaagaccacgagagaaaagaggttactcttaagccacagtgtagggaggcttgatgaaaatccacagtgaattcttacctctgactcttattttccagctacttaaataataaagaaacaaaaaatgtgagcttattttaaaatctacactcttcaaataagttttccatattttctgactatggaaagataattttctgaaaatgtctcatctttggccagtgggagtctctttaagtaggctcctgttgtcttttaatataaccatagttgtctttgttaacattcttgcttttaggcataaaaagatatctaggcttatgtattttctgtcctagagctgagtgtacaattctccaagaagtcttggttcattttagtggaaaatggtatttggagatgacaattttggcactagaagtgttcattgatactgagttattgtttctaaatctttttagcagatatagctgggaaattttttaaaaaaaaagaaagatttttttttttgaggtggagtcttgctctgttgcccaggctggagtgcaatggcacaatcttggctcactgcagcctctgcctcctgggttcaagtgattctccctcctcagcctcctgagtagaaagttaagtaatgagttcatacattaattccagttcatattaaggattagaatgatttttacttctttgattttatgcctagatctctttcatgctgaaaattctagttcctaatgattaatgttaatataattgttcatttggtttatatatatctatgtgttatataaatataatgctatttgggtatttttatatatagttttaaaataacaatatcaatgttaccactaacatcaagactacaggatgcaatagaatctctttatggttctttttgtctttaggctataatctactgtatagtcaaaatattgtgttttaaaatcaattgaactaaatcttttctgcttggttatgctaccaacttgaagtacagttcatttcctaatttttcttcagtatttaaaaattggtctttttcatttttaattgaccatgtgaaacattttacctggttccaaataaaaactgtaaagcaaattatagttagaaagtctagcttttatccttttactacttcttgttttctcccttaccctatagataactatttataaattgtgtgtgtgtaatcttgcatttttttcttagaaaaatatgagcatatttgtatgtgtatctatatttatgtatttatatctgtttatctatatctattatccccttttcttacatgtttctttaccctgatttttttcacttaataagtcctgaggatcactccatagcaacatataaaaggtcttttttttatgtatgtgaagtcctccattatataaacattccttagctttttcaacaagatacctagtgatgaacatttgagcagtttccagtctttgttttaacaaatagagaaattagtttgctctaatacataatagtgtctgattctctacagcctcactaatagattagtcatatttttagctttttgccaacctcataggtgagaaaaattatctacctcaaattggaatctctaaaagacagagttaaaggtaattccaaggaagtagggagtactctctcaaggaagcaacagtgagagaaaagcaaagggaggaggaaaaaaggagaaccagtacaaggtaatgagttaccaagctggccatagcttcacaagaaactcagctgattgcttggtaaggagaggcggtttcttggaaggcgggatagagtagtacaattaatttgattgcaatgcagagagaaaaagaatagcaggaataggcaggttgataacagtcatgtatagcttgacaacagattaaaaatttacattttgctgcattggcagtggaaaaccaggaaacattttgagcaggaaaatgattaagagcaaagaggattttaggaagattcaacctggattaaggttaggagtgtttagggaacaggtcactagttggaaaacaattacatgtccagatgaggagtaatagaagactgaattaagcattgttggacaaaatatataaaagaagacagtctgagcaaaggatgcttaatttgggaactttggcagaccttagagaatctattattgggttctaggggtttgtaaacctctaaaatgataagcacatttttgtgttccaagtatgttcagtttttaggagaaagggtttttggctttgacctgatgctcaaaggcatttataagacaaaaaataattaggaaatcctgaatcaatgagattttgtgatcactgatagatttatgttgtaaataagcctcatttatgaacttaatctttgatgcattttacatttttacaaccacattcttccaactcctattgtacttattgtctgtgccactcattttaacatctaacttgtttttgtaagttttgtttttcctacactgcttttctttttttttttcagatggagttcccctcttgtcatccaggctggagtgcagtggtgcgatctcagctctctgcaccttctgcctcccaggttcaagcgattctcctgcctcagcctcccaggtagctgggattacaggcacccaccaccacactggctaatttttgtattttttagtagagatggggttttgccatgttgaccaggctggtcttgaactcctgacctcaggtgatccacccatctcggcctcccaaagtgctgggattacaggcatgagccacgatgacagggctacactgtgtttttcttaaagggacacatctgcatattgtcctcagtcacaggttactatacaacatggtgactatggttagtaacaatgtcttgtgttttgaaaattgctgagagtagattttaaatattccaatcagaaaaaattataaatatgtgaggtaatgcatatgttaattagctcatttgagccattccacaatgtatatatattttgaaacatcatgttctacatgataaatatatccaatttttatttgtcaattaagaaaataaaggaaaaaagtaccacttaaataaaacttgcttaaaaacacctattaagctagacatggtggaagaaattggcaaaaatgtaaaatatctttcttctcactaaacatttttagtttggaatcaaatagccatttaattaaagcattttatttacctaaaaaaaaaaaaaaagacacctaccaagcacatacacacatagaactaagaactaaacccattttttgtttttcacttaaaaattttgttttaatgtaaccttttttcttttttatccttggctactaagaacagaaatagttttacatttctttgttgcatcagaactcatcccaggagcataaaggcctgaaatgaactctgccttatgatactcacatttgagaaattccattagaacacagatggatctgtgtgtggtgatgaactcggagcaggagagaagggctttcatcacttcaccagggtcctgaacacactggaaaccttatcaggccccatctctctccttacttggaataagactttcccttatgtaccaaaacaatgcctcccatctcagctaagaggaagggagctaaagggagcattttgagttgttgttttaaatttataacattaaactgttcattgttaagaccctttgatcagctttgaggttttccttttacaattgattctaaacaccataaaattggtgcttctgtgttggtacttgcctcttgagcatttaacaaatatttcataaggtgtgttagttatttttcaggaaaagattaaactttagctttgagctgtctataaggctacctagaaattcaatttaatattaccctgcttcagttgaaaaataaagtttagagccatataaaattaagaatctgtaactaggataagtacagaaataaacttcttaaacacttttgaaaagtatattacaaagcacaatttttttttctttaaaggaggtattcttatattgagattagaaaagaattgtttaaaactgtcaaaaggaataaaattctttaaactgctgctgccactggatctgaatgtctgtgaatgggagacttaatatttttgaacagctttattgaggtataatttacttaccataaaattcacttgttttaagttcagggatctgtaaatttaatgttattaaatgatggtcacaagagctacttctggctctgtagtatatcttcatagttagtaattattttgtaattatgtcaataagaggatccccaaactggtcacaattttgataagaaaaatttttagaatcctgtaaggaaatttgtcagatgtatctttccccctgtacattattgcttgtctatttgttactcaaatttaggccctcatgtttgagatactgcattccacccacacggcaatctatgaaatccccaggatatgtgttataaagaaaggtattttcaatttggagaaaatacaatgtgccaactgaagataatttcaacgttattttttaaaattaagatgaaatgaacaggttacaaccagtaaataaagagcgacttaacactcttgttacctcattaaaattatttgctgtttttaagttcatttcttgctatttagattctggagagaatcttgaccctcgaaatggaagatctgattttgggtcctgctgtactactcacagggtgctcatacatcctctcgaattactcacagtctctggggcttattttccccctataatattggaattaggatactggcattgagtaatttagagggttttagtgaggagcaatggaaataatattttaaaaaatgctttgttacacacaaagtcctgtgcaattgtaaggtattacgtttaatatcggaactcaataaaatttctatattaatcaaaataatctgcaaatggttctaagtacctatctatacttggcactatatattccaagataaatatatatggctcttaggttcaaactgttaggctgtttggtccacatggaataacgtagggtggggatggattccccaccttcaccttcaacttcatatgctttcctattgcaactttctagatccctgtttattatcacataaaaaaacccccaaaatacttagtagtaacccctgaagaatgactacaactctttagataaagtgaagtaaacgtgtgcttctaattaagtttagttgtagagcaaattagagtgcatactttgtaaagcaatctaaaggtttcattaaaaattgtagagaagtaatgataaaattatagtggtaaagctaatgccaaaagttattgctctgtgatggtggcatcccaagccttacattttgtcctcaggaattccatgggttgagtcaaactatacattttttttctccacaaattttactgtgactagcagttgtttgagctttgcttttgatcattttctagtgaggaggtggaggggatttgttcagggagagtaagagattcactcatgtcttttaaaactatgctttcttcagggtaggctctgtctttcaggagaaactctgacactcctctttcccagctgctttgcagggagccggtgttcctggtgaacactgtgtcctgtgaggagcattttgacaaatctctctttagctgtcttatacatgtatgagacataagaaatttatgagtagctagagtgtaagaaattaaatgacatagtgcttacttccactttctttagcatattcccagaacccctcatatactacttttgcatagacgagatgctcagcaaaaggagtaattaatataaaaacattctcctttcttttttccttctcactcaatgggtccacgttggtttcatactaaagtagttcagaagtcaaattgtgtagctttactattgccctttctaaaggggctcaaacctacatatgaaagcaaatcccaatatgtaagcctttgtgtggttaacatttctgtctactctctcaatagtatggatttaagtgatatttttcatggtgcctggaatgagatgtagtgattcactgtcattgtttcacagaactaagatggcataaatgctgtgctgatcctatttttagttgccttcacctgtcctcccatcatgtaacaagtctacataagaacattttaaatatgtgcatctgtttgtgttcctagtttgtacaagtggaatgacagagtggagtaccagttagagtgcaaacaacctgctactttcattcctaataacgtcatacttactaaacactagttccactctctatgcatgtcccaccattgccacatttcattaaactgcagggagaagcatgacactggccaacactgcgtccagcatttgggtggccctcaggatttcccagtcctctgaaatggccatccttctcagtgcgaacttgaagagtgaaaatacagccttgaagaaatgcaaaaacacttcgtgttaacaaacagaagaaatagaaaaaacaagaagaaggttatttttcatttttaaagtagaagtttttcaaaataaagtaatacatgtaaattttaaaagaaatataagaatacagaaatgcgcagagaaatttttttttaaaagtcattcatgatatcatttcacagcagacaactattaacattttggtgtgtgtgtgtgtgtggtattttttctatgcttagtcatattttcttttaaacaaaaatgcaatctgcactaagctgtagaaaatataatattataccaaaaagttgaacatcataaataacattaacttttttcttgtagcattaactatttttaagtgatggcatattttcttatatcaaaatatatttaataaacctataattattataccattgacttatttatactttttgctattagaaataaaattgtaatgaatatcttatgtgtatatctttgtccatttaaattatttttagtacatatttctagaagtagaattactaggggaaaagatatagatgctttgaagtatgcctaagtgtcccccatagatcacaactggactcaggagactgggatacccctttcttcacaggcactaccatgcctgggattaccattccatttcatttttacatgcgatagctaataaaatactattttaccgtttttggttgggtatcaaaaatcttttaacaaatttattggtcattcataatttatattataatttgtatttatagtatataaagagagtctccttatataatgaggacattagctatttgtaatatacggtaaataaactttctccagtttaatatttaccactcaattttgctatggtagttttttttttttttaggtaaagaagtttatgtttatgttgtcacatttttctcttttttctttcagagattttgcctttctatacatctttagaaagaacttctcggccgggaacggtggctcatgcctgtaatcccagcactttgggaggccgaggcgggtggatcacgaggtcaggagattgagaccatcctggctaacatggtgaaaccccatctctattaaaaatacaattagccgggcgtggtggcgggtgcctgtagtcccagctactcgggaggctgaggcaggagaattgtgtgaactccagaggcagagcttgaagtgagctgagatcgcgccactgcactccagcctgggcaacagagcgagagtctgtttcaaaaaaaaaaaaaccaaacaaacaaaaataacttttctaccccaagattggataaatatatgtaaataaaaaggacagttcagtgaaaaatttgaaatgaaagtgtttgaaatcctgaaatgtattgtaattttactcagctcctttagcagttacttatagtttatttgcaaagttctttcaaataaatgggaacatcaaccagaaataaggtctttaaaatgataaaataaaggcaagattgaattttattttcaaaacttttttttggaggcataaaaagctttctttttcttttttttgtcattgttatactttaagttctagggtacatgtgcataccttgcaggtttgttatactgtatacatgtgccatgttggtgtgctgcacccattaactcgtcatttacattaggtattcctcctgatgctatccctccgcactcccccgaccccatgacaggccccagtgtgtgatgttccccaccctgtgtccaagtgttctcattgttcaattcccacctatgagtgagaacatgcagtgtttggttttctgtccttgggatagtatgctcagaatgatggtttacagcttcatccatgtccctacaaaggacatgaactcatccttttttatggctgcatagtattccatggtgtatatgtgccacattttcttaatccagtctatcattgatgggcatttgggttggttccaagtctttgctattgtgaatagtgctgcaataaacatacgtgtgcatgtgtctttatagcagcatgttttataatcctttaggtatatgcccagtaatgggatcgctgggtcaaatggtatttctagttctagatccttgaggaatccactcactgtcttccacaatggttgaactagtttacagtaccgccaacagtgtaaaagtgttcctatttctccacatcctctccagcacctgttgtttcctgattttttaatgatcggcattctaactgatgtgagatggtatctcattgtggttttgatttgcatttctctgatggccactgatgatgagcattttttcatgtgtctgttggttgcataaatgtcttcttttgagaagtgtctgttcatatcctttgcccagtttttgatagggttgtttgattttttcttgtaaatttgtttaagttttttgtagattctggatattagccttttgtcagatgggtagattgcaaaaattttctcccattctgtaggttgcctgttcactctgatggtagtttcttttgctgtgcagaagctctttagtttaattagatcccatttgtcaattttggcttttgttgccattgcttttgatgttttagacatgaagtccttgcctatgcctatgtcctgaatggtattgcctagattttcttctagggtttttatggttttaggtctaacatttaagtcttcaatccatcttgaattaatttttgtataaggtgtaaggaaggaatccagtttcagctttctacatatgactagccagttttcccagaaccatttattaagtagggaatcctttcccaatttcttgtttttatcagatttgtcaaagatcagatggttgtagatgtgtgctattatttctgaaggctctgttcttttccattggtctatatctctgttttggtagcagtaccatgctgttttggttactgtagccttgtagtatagtttgaagtcacgtagcgtgatgcctccaggtttgtcctttttgcttaggattgtctgggcaatatgggctcttttttggttccatatgaactttaaagtagttttttccaattttgtgaagaaagtcattggtagcttgatggggatgacattaaatctataaattaccttgggcagtatggccattttcatgatattgattcttcctgtccatgagcatggaatgttcttccatttgtttgtgtcctcttttatttcattgagcagtggtttgtagttctccttgaagaggtccttcacatcccttgtaagttggattcctaggtattttactctctttgaagcaattgtgaatgggagttcactcatgatttggctctctgtttgtctgttattggtgtataggaatgcttgtgatttttgcacattaattttgtatcctgagactttgctgaagttgcttatcagcttaaggagattttgggctgagacaatggggttttctaaatatacaatcatgtcatctgcaaacagggacaatcttacttcctcttttccttattgaattccctttctttcttcctcctgcctgattgccctagccagaacttccaacagtatgttgaatgggagtggtgagagagggcatccctatcttgtgccggttttcaaaggggatcctttcagtttttgcccattcagtatgatattggctgtgggtttgtcataaatagctcttattattttgagatacatcccatcaatacctagtttattgagagtttttatcatgaagagctgttgaattttgttaaaagccttttctgcatctattgagataaccatgtggtttttgtttgtggttctgtttatatgatggattacatttattgatttgtgtatgttgaactagccttgcatcccagggatgaagccaacttgatcatggtggataagctttttgatgtgctgctggattcagtttgccagtattttattgaggatttttgcattgatgtttatcaaggatattggtctaaaattctctttttgtgttgtttctctgccaggctttggtatcaggatgatgctgccctcataaaatgaattagggaagattccctctttttctattgattggaatagtttcagaaggaatggtgccagctcctctttgtacctctggtggaattcagctgtgaatctgtctggtcctggacttttttgggttggtaggctattaattattgcctcaatttcagagcctgttattggtctattcagggattcaacttcttcctgctttagtcttgggaggatatatgtgtccaggaatttatccatttcttctaacttttctagtttatttgtgtagaggtgtttatagtattcgctgatggtagttggtatttctgtgggatcggtggtgatatcgccttcatcattttttattgcatctatttgattcttctctcttttcttctttattagtcttgctagcagtctatccattttgttgatcttttcaaaaaaccagcttctggattcattgattttttgaaggggtttttgtgtctctatctccttcagttctgctctgatcttagttatttattgccttctgctagtgtttgaatgtgtttgctcttgcttctctagttcttttaattgtgttgttagggtgtcaattttagatctttcctgctttctcttgttggcatttagccaaccatttgactgactaggtaccaaataagtaatagcttttttttttaaactgcagtatagctttttttttttttatcctgggtttctaaattattgcagtaaactgattacattttcccatatgggctcttctttgaagaatctcatatgattaaaaaaaggagagagaaaaaaattgaactcacaagaaaccgaaagtactgaccgtgttggctatttttagatgagaataactctcatttacagggttgttaataaatctgaatctatctcatgtccactctattcagagtagtaaatatttaataacctccatatcaatgagcagtagttgctgtaacactagaagcttatttcctgttcatgtaaagtccaaagggtggttagggttggcatccaggtgagttggcaaacagagtacaggactgtgcagaagattttcataggcaaggcctggaagtagcaactattacacctgctgacatctcactggccagaactcaggcacatggtcatgcatagctgtaagagagtctgggaaagatctggtggtaacaacatgtcacaagcatgtattatgtgaaagcaccattccaggtgctgtggagatctgttatcagtaaaaactaaaaatcctattctccagaagcttactaaattctaaattaagacatacattctctaggtatataattatattaggtatgaaatgctaagtgggaaaagacttggtgctccaaagacttcagaaagagctcactctcaatgagtgagctcagagagtgggctctcattgaggaggtgtgatttgagcttgctttccaggcaaatggaatttgaagaggtggagaatgctgatttaagcacgggccctgaggcagggaaaataagacatacagagaggcagtggctagatatagtgatagttgattttatgtgccaacctgacttggccatggggtgcccagatacttggtcaaatattgtgtgtgtgtgtgtgtgttaggatgagattaacacttgaattgataaactgggtaaagcagattgccctccctaatgtgggtgggcctcattcaatcactgaagacctaaatggaacaaaaaagagggaattcttcctgcctgattacttgagctgggacattggtcttttccagccttcgtacttggactgaaacattggcttttcttgggtcttgagcctgatggctttcagactggaactcacaccacttgctctccttgttcttagggtttcagactcaggctggagctacacatcaattatcctgggtctccaggttgctgactgtggattttgggacttctcagcttccataatcatgtgacccaattccttattaaaaatctctctctctctctctctgtgcacacctgattggttctgtttctctggagatgcctgactaatacagatagattttattgaattaaaaaatcagtggaagcgagttaagtatagaaaaaatacatgggttttggaatgtcaggggtgttagtccattctcacattgctgtaacttactacctgaaactgggtaatttataaagaaaagagatttaattggctcatggtttcacaggccatgcaggaaccatggctggggaggtctcaggaaacttacagtcatgatggaaggtgaagaggaaggaggtatgtcttacatggctggagcaggaggaaaagagtgaaggggggtgatacacactattaaacaaccagatctcatgagaacgcactatcacaagaacagcaagggggaaatctacccccatgatccaaacacctcccacttggcccctcctccagcactggagatcacaatttgacatgacatttgggcaggaacacaaatccaaaccatatcaccatgtaaaaaattcagttattattctagagttgacagggtgtctgttgcgttctagagcaggaaaatggtataattcattagcatggcaatagggttatgatgtgtcagttaatcagggaagggtgagtagtcaaagatgacagtaagcctgtcattctaacttcagttgcatcagaatcacctgaagagctcattaaaatacatattactgggccccattccctgagtttctggttcaattacaatttgcatctctaacaaacttcccagtgatgctgatattgctgacccagggaccacattttgagaaccactgtacaaaggattcaaacaagtattagagggactggtagcaatagtaaaagaaataagtaaagaagtatattcagaaaaggcatttgtggtgaagatgagatgtttcacttcagttattctgcttctatagctgcctttagcacaattaacagctcagcaagattatctacaggcaacagaacttctagtgaaaggacccagcttattttcacttgtggcctaaccagttttacttgtttcttccccttattcctcctttcccttcttccatatcttcttgtcttccttccttcattccgtgcccagtctgagaccaccattcatgagcctcattctgagaactctgcagctttgtagcagatgcaactttggaaagcagaggagaggagaactgatcttattagggcagataaaacagtaaggcacagcgtatttggcagatgtagattatttaaggtggttagtctcaatacctttatgagcattaaaggtcatagaaaaaataatggttcattataagccattttttagaacaaaaacaaatgtgctttattagcagtaaggatttatattttagatcacgaactttggattagagttatttatcaagagtttataggaatcggctgggcacggtggctcaagcctgcaatcccagcactttgggaggccgaggcaggcggatggcttgagcccaggatttcaagaccatcctgggcaacctggaaaatccctgtctctaataaaaatacaaaaattaactgggtgtgatgatgcagttctcaagttcatggatagtaggccagacctggttgagtgactgagaacactataagaacagacctttgaccaagtaccctgggactaggatctaccaaaaagctatcttcaccaaatgaattgttattacaatttaaagcatgtctttattttataactctactacaatataaatcagctttgtaaggatatgttagctgggtttagtggctcagctacatgagaggctaaggtgggaggattgattgagccctggagatgaaggttgcagtgagctgagatggcaccactgtactccagccttgatgacacagcgagactcaaaaaaaaaaaaaaaaaaaggtaaagtaaaataaaaataaagagtttataaaaatgtaaaagcctagatcagataatattttattgcattatttaattgtaattctaaggacaaatgtgatatccttactccaactattaaattctttcagaaaattccatttgctttgcttcgttatgattaattaatgtggtggcttccacatcattctcagcaaattaacccaggaacagaaaatgaaacacctcatgttctcactcataagtgggagttgaacaatgaaaatgcacggacacagggaggggaacatcacataccggggcctgtcaaggggtggggggcaaggggagggagagccttaggacaaatacctaatgcatgcagggcttaaaacctagatgatgggttgatgagtgtagcaaaccaccatgacacatgtatactatgtaacaaacctgcacattctgcacttgtatcctagaacttaaagttaaaaaaaaaaagagataatttaaaaaatatatggtggcttccaaatctgggaggcttgttaaaatgcaaatttttagatcccactgtaaagatttcaattcaatagttcttgggtagggttcagaaatctgtgtttttaagaagttatcctatattattcttcagaaccagtagagatcagctttgggaaccatggatttatggtacagttgcaatttggttgtcctggtaagttggtaacaatacgccatgatttataataaatagtaaatgctagtttagagtggagggaaggcagacattaagagaggatccaagagaagaatgataaaattaggggatctcaaggtcctgaattttctataagactgtggcataagtggcaatttccaagaagacttgcccaagattcccatactcactaaagactgtggcagttgacatacttccaggagtgtgcaatcttaatgtttctgtaagagaaagggccagctctgtgtgtgctgatctcatttgaacacggaactatttgaacacaggaagacagactgtggcaataagattgctcacccaagcacaatgttgtccttaatcctcttggcttgctctggcctctgtgggctaccccttggtggtatggatgggttgactgcagtctgtctcttgccttttgaacttcaaagttagatggactttcaatttttactgtgactctttgaagtctaccctgctcagcctattttaaaaagcaccctgtataaacaattacccataatcctgattcctttaaatcatgctctccatttcccttttcccattgaacttatcacattatatgactatataattaactaattacatttagtgtttatctctccaactagttataagtgcagaaatctttgatttgttcattaaaacatcctaaacatctagtacatatgtagtaagtggtcaataaatagtaaatgaggctgggcatggcctgtaatcccagcactttgggaggccaaggcaggcggatcacctgaggtcgggagttcgagaccagcctgaccaacatggagaaacctcatctcctaaaaatgcaaaattagctgggcgtggttgtgcatgcctgtaatcccagctactagggaggctgaggcaggagaatcacttgaacccaggaggcagaggttgtggtgagcccagattgcatcattgcactccagcctgggcaacaagagcgaaactccatctaaaaaaaaaatagtaaatgaatgtttctgattaaaatcaaactttgttcaagtctgaaagcaatccatatagctggtttgggaaatagaagtatactctttaaaatatttttttccctcaacatttgaaataagtaggtataatataaaaaatgtccatgccttaccttgaaaaccatttttaaaatctgctccatttggtaagagatctggagtgtattcactgtagccacctacataaaactgactgaagacattgagaccaaccagtcttcctggggcgataatggatttatttttatgatcatctaccttcgaaagggaaaaaaaacctattaaaaaaggaattaattccccagggtgaaatgttaagatactcttttgttatttcccattaacttggcatgaaaaatttacaaagacctgaattttgaagaaataacatgataccactcaattctctgcttctctgctggtgtctgttaccagggatatattaatatagcagtcatggttttgcatttcaatcaaaatcaaagttcttcaaagattaggtgctggcatcctgctgattcccctccatttagccttcctcctctgctatcaattctccatagaaccaccagagtcctttatcaaaaattagaaatcaacatggtacccaccttcctaagtagctcttcatagttctttagataaaaatataaacttcttagcacatctaagccctttgataatatagaccttatctgtctctaaccacttctctagctcccccatcccccaacctaaaaaccatgctgaactacttgcattccttaagctaatactggccattgttctctttcttaactcctatttgaagttacgctcaagcatcaccttctctgggaagcactttctgaatcctctctctcacccttatctgtgttagtaatccctcttatttgttctcacaccacttaattgtaatcatctctctattcccctagttggtacaatagtctgtgaacttcgtggatgtaggcatcatgggctattcacctctgtatcttagcacagatctgacaatatactagtgctctcagtttgtggaagtgacgaaggaatgactctttaccttcagccagccctcttggaagaacttgcccagatgaacagtgtggactccaaggctcagattgaggggctcgctcctgatgcttgctatgccagaccccaggttataactataaaccacactgccattgagcaggcccacagccaggaagtcatcgccattcaaccctggaatgagaagacacatggggaatgctcactgagaggaaattcaggagttccgtcagctttattttactgactggttctgaattacagatcagtatggtaagttataatacatatttagtctctagtcagcatttaggtatatgtgcaactggctgttgttattcccagccccagaaacagagcaccaagagtttatgtctttgaagccatgagggttctggtcaacctggggaatgatcaatgatcaactaaaaagttgaatgggattaaaatctccttttgtcggagtgaaattcagtgtgcactttacaataaggagaacttcacaatggagtagaattgctccggtagctaacgagattcaaaaggctgagatgacctagcatcagctttgaagttctttctatgatttgagaataggataaagaccaatttattcctatgattgctaagaatatgttatcattattctattacaaaagctcttaaccatgccccatgaccatttaaaggtggattgtttctgtgttccctcttctctctctccttccattagttcagagccatccatgcagtacagtgagttccaggacccagaacactcaggagacagttcttaaagacccacgggacaaaggaagtggttgggagtgacccagcattaatcactaggggaaggtgctagcagtatccttggcgggattaagaagttctgggatgatccatcagtatatagcaagagatctgttcacaggaagcagagacccaaatacgtcacccagcttctgaaaggtgtgttagtgggtggggcaaaagaagaattcaatactgaggctagcagtcaggaaactgaggcaaagacttctgcttagaggaagaacgtaagaaccccctagaagtaagaggtttaagcatgggagaaaaagctgaattgagtccttgacatagaaaaaatttattatgagtatgcacagcctcctccttctgcatttataggaatgatgctttgtctgttgactgggcttctagtattactttgatcagggtaaaggagagaaagatctacagggaggtaggtttccagatagggtggagaggtgggcttcctgaggcactggaaagtggaagacagaaatattatttagagatacttgaacgctgcctctgcttttctaaagggtctgccatgggccctgagcagggttacttttgaaagctctctaggtgagtctaatatatacagtcatggttaagagcaactgtattaagtgacctaccatagaccgagtacattgggaacttatggcaagtctctttttcacttcctcacattctggtgatttcttcccacctgcaatgctgcatcaggttagctgggttgtatatttaaaacggaaagttcaatgtttcaagagaaaacatagattcaggaaggcagttagaaaggcagaaaggagaaaacaatactagagattggagatagtctttcaggcagctgttgggatatagaagaaattgggaggggtggaggaggaaacatgagatttttctgtgggttgtgaatgggaatttttctgagagattctggaggggatctgaattgtctttcaaattgtccaggttatgggagtggagccagtattgtgccagccgagctgtaaggtagtgggagggcatattcatttcagctgtatccttcctttctgtcttgtgctctccttcctccagttatggagaacccatttcatgccaggagcatcattattatccttaggtccttgacagcctggtcaggaggagataggaggtttgtttcaagttccacgaagagcagaatagaaacaaatgggggcagccattaagacatggtgaggaagagggttaggaaagcaaaaaggtggtttttgagtcagtttctgagctcacccagaaaatgacaagcaagagcttgttagatgaaaaaagaggatacagtgaagagtgctgtttaaatcagaagggagaactttgcagcaacccagaaggagaagaacagggtatgtttaagaactgctggggccgggcacggtggctcacgcctgtaatcccagcactttgggagaccgaggcgggcagatcatgaggtcaggagatcaagaccatcctggccatcctggctaacacggtgaaaccccatctctactaaaaatacaaaaacaaaattagccgggcgtggtggcgcatgcctgtagttccagctattcaggaggctgaggcaggagaatggcgggaacctgggaggcagatcttgcagtgagccgagatcgtaccactgcactccagcctgggcaacagagcgagactccctctcaaaaaaaaaaaaaaaaaaagaagaagaactgctgggatgtgggcttgactggcatttagtgcctgtggcaggaaaggaaactgaaaagggagaaagggctatatctttaagggtctaatatgctgcaatgaatgatgtaagtattttaccagagactcttaggaatcatgaaaggattttgaataagagaagtgtattagatctggatgttagaagaatcttctagtaatgttgaggatagaatatagaggtacataaggaggctcattggaaagtcattcaagtgattcagaagaggaaatgatactgaaatacattaaacacctaaataaattaaggtagtgacagaggggtcagaaaaatgggaggaaatttgcttgtgatttggaaggaaaatttgaaaggacagatcaatttgggtgaagagctgaggaagagttgaggaagagagagaaggtggttctgcagaatctggcttaaagaaccaggtgcagtggcagggtcagtcatggagttaggaccctaggaaaggaacagtctgggggaaaaggctgagtttagtttataggtgctcctgcctacagacctgtcccagggcaaaggactggggatgcaccaagaggaggggataaggagagccagggaaccaatcacccatcaagcagatgatagcatactattcccatgccatgagtccatcaggttgctttcctttcctctgctactccttcaactctagatcttccctgagtatcaactctggtagtaaatgatggagtagataagaggaagaaaagcagtttactgtcacagccggtacctagaaagtgacttggaattgttctagagtgtttccaaacctagaagtcctttacaatcatttagggaatggttcaaaaatacctaatgtaaatgacgagttaatgggtgcagtacaccaacattgcacatgtatacatatgtaacaaacctgcacattgtgcacatgtaccctagaactttaagtataataaaaatatatatatataaaaaaacaaaaatacactttctagaacctgtcttataccacttgcatgagaatctttgaagctagatcctagaaatattttttaacagaatccccaactgttttttttttcgtaataaggcctgattggtattagtaactgtaagagggccaaggcatgaaacttgtgcagttgcatggggctttaagttccaaagggccccgttgcttggtttaatgctctgtgtcactgtcttgaaattcttaatacttttatctttgaactgtgttttgaaagtgaagtccatgaagcaacaaacatgagtggtaacagaggagacccataaatacaatatgcatgtttgctctttcacatgtaaggcttgtgatatcccacaagaacaaagttcccacagtactgggagttcagtgataacgcaaaatgagtacaaggtaaatatattatgtttaatgactaagtgggggatctgacagccccaagaggccatgctccatttgggccagaacttacttcaaatgcaggaagaagggagtggtggtctaagaaacatgaatcatcaaggaaccctattatttcatcattactcctactacttttctgtattagctaattatttacactgaaaatgatgatagagaagaaaacagaaagagagggaagtccacaattccttttcctctcactcctaccttactcatcagtagccaaaggtcgagagtgttgatagaatgtgtgtatatcaagaactgaaataaagacagttaacttagatttgtgtagtgtttctggtgttctgttaagaaggaagtacatatgcatgcacaagctttgaaagatcaattgagtaattttggtgattttgcatgtgcattaaatacttttctatttgccttttaaagtggcgttgcacaatataaaaatgaatggtaaattttaatattttaattttttaacttagaatgacataaatgcaaataaaagacattatggtgactttctaagttaagcttagtcattctaagcttattcttactcattctaagtcattataatgttgagagatcagtgaagaaagaaaaatgctttatattttagtacctttaacggcatttctccctgctttttgaacaagggagtttgcctttttattctgcaatgggtcccacaaattatgtagctgtctctccttggtgtcatcataaaacaaatcaggaaagaacaaaatgaaaatgagaccttcctgaacatttgaggccgcttagagcctttgtatgtagatgagacctgaaacctgtcagggcagtatgtgtggggtgatgctgatgcacacatggatgtctgaaagcgatgtggctgctaggtggtggagtctgagtctgaagacagcctggttccagagcctgtgctcttaaacactgtccatgcagcagagaaggagaaacaagtctgactgtggttgtgcccctctctcccaccttcagcactcccttcccaaatgcttctctctgggaaataagaagggataataatatctcttcagattattctaaggattaagtgagatttaatgtgtaagcattagcccactgccaacctagcacatagtaggtactcaataaatgcatatttctttcctcttctcagtaactctggcctgaccataactttgtgtaccttatttcattcccccattttataaagtctgggaagcaggcattcctggctcctagttagcctcttgggtcgggaacagaagtagtacaatttttctttcttgtttttttgtttgtttgtttttgctatagcccaaattgcttcagtgcattactttgatccaactaaaaaattttggaggatcaaacatggaggtgaaatgaaatgacttgaaggcatcatttttaaacatctatttatgtcttatgtcactttcctggaatttcttgtaatgggacgttcttggcttaacagcccataataacataagcaatggcatattcaaacaaccaccaatgctatagaattatttcattctcaaattcagctttctataaaacattgttctatgagtagctttgggaaatatatgagcaatttatatttttatatttgtcaagtcacaaagcaacaggtgataatccacatttgtattgccatgtagaaatgtttagcaattgacatggtgagagttttttcatgaaaagaattggaaccaagctcatttggtatgcagaacacaaacccacagtgaatcttaatgaaatcagccctaggaagatttttagacaaggcaagagatacttgttggatattgcttcagagctggtgctaagaagaaaggacttagagagattatgttgtgcaagtagtaaaaagaggaggaaggaaacaataggaagtgactctacatgaatagtagttaagcatatcaagatctgggaagtgaataaaaatccttttagaatgcacaggaaaaaaaactggatctctctttggctagaaagaaaagtcataacaactccatcagcaccattaagcagtgagtttcaaagtaagtatgttgtggcaagccatgcttagcattataacagcaactcataagattggttagagcaaatctcatggggcaacaagatgagatgctgtggtcagaataccatctggcctcataatgcaccaagaatagtgatttattaatggaagcaaggatttagtctaggtgaagaagtggatggtggcattgttagggatgggaatgatgataaaacatggaaacaaggtaaaggatgctgctatgaatattctgaaagaaaagagcaaagtagttgagacaagagtgtcaggacattctaagcagtctcagatgggttttaaaagtttgatgcagaaggtatgggtggtagtgatagtaacagatcttaaatatatacaaccttgggagcaaatatgaaaaaatgtttttgtcacaagcctataattatagttaagcttatggtattttttccctaaattacttaggtctgcttgcaggatttttccgtaggtggtttgattttaaacctaaaggttttactatttatactggtagttctccaacctggctgaaccttgtcagcacagcctctgatttaatttgcatgtatgaacgagaaggggaaatctattatataggaaggaggaaaagaatcaaaggtttcagagagtaagcccaggagaaactgtgcaagtcagcttgacctgaaggaaaaagagagaaacataacaaggagagaaaattgtcagaactgtgcggcaaccctgagtgccttatggtaatcattatgaaattctcatgagaaaaaaaacatgcccatgaagtaactgtaattagaagtggtctaattagttccaccttgaaggatggcctggacaagagtagctagtggttcaagccatggattcattaatgaaaccctcaaaggaagcataaaactcatttattaaagatgtaattcaagtctgtgctttggagagactttcgaggcacacccgtcctgctgtttctcctactgattctcactaatcattgtgtgttgtaagttatgaagtggtacatgcttgtgttctcacttgatgtgcttagggcgtaccccagaaattagaactacttgtctggaagtggcagaagctcactctcaagttctttacataagggttcacaatggtttagaagctgttcctcggattgttctgaaggggcatattgggactctaaaacatttatatagacagtgctgtgagatccatgtgtatttcagcatattccagttaatgcaaaggttaatattgtgacttttaacatcatagaaacatggtaatcctcattcagatgatccaacagtcttttaattccaatagattaaatttcctaaagtatttcatttagaaggaaagacttaatagtaaaggaataatagttgtaatttgttatttcttcaaactattattctaatatggtaaaatagtatcatttattaaatttaatttattcctctaaatatgataatgtactttgcagagttcagcaaagtcccaagtagtacaaggacatgagcgtgtaatcttggacattttgctaatttaagttttggctgctcacttccagttatctcactcttttgaaaaaactggtaaagataacacctcataggattgtctctaggaataacttcaagtgttttaaaagatatttccaaatggattaagaaattctaagtgacaagtaaattttccttctcccttcttcctttcctgtcaaggctgaaagagaaaatgtaagaggagccacaacgatggtgctgtggttctcccaccaaatgaatattgcttacagaatggcgcttgattactggtgggagttcccatctggaggaatgttttgtgaagatatttttgcagccatatttgattatagttctagggcttgtaatgccttttgatttctgaaagaaggaaacgatcttttgattaaatattcttaatataacaaaataatgattctgcgacagagacacccagatgaacctaattgagtttcagttgtcttttcaactggctatgagagggtatattcagtttttaggaagaaagtgaaattagatatgaatgaaaagttaaataagtgtgaaaggtcttaggaaaattatagaagtttatgcaattagaatcaaaactaaagtaaaacaaaaaatatatatctaggtcgatacgtgagaaacaagacccaaacgagtgaaagtccttactgccggaacaagatgtatcgagtgatataggattctagacatttgagccatttttatcccatattcagttacagtctctactttaggggatgctaaactaaaattaagatgactaaagattttggattaactcttaaagagcatatagtctctttttatcttagacctgtatagctcctgttcatagtggcaaacttttggcttcctgttctgttgatgggactattcagttatggatattctagggttttgagagcattagaaccatgtacagccatgaccatgatgtttcatcattagccattgagcacaatggatacaatatagtgtctacctcatgggattaaaaccattaaaatgtaggcaatgtagactggctctttttgtggccaaattaatatggtgtcctgacttccatctgtgctagtgaacagacagtgtggaagggttgataggaacaacaaatccagtgctatgctcagagaatatgaaaatgtgataaaatgcatttcttggggctacatatggcccacatttttatatctcttgagcaaaaggaggtgagactagaaaaagtggcaaatctgtatctctcttgctgtcagagatgagactgtgaaaataagggatgtaagcaccagtttgtgggtaaacttaaatttccacaagatgaaaccacatgggcttactgcaagtatagtgttcccctgtgaaatcaaggttacccactttgaaccatccttaagtgtatattccctcttcagaaatacatttgaaaaaaagatgggggaagatttgcaagtatctgtatatctttgtcatttctaaccctgtttgaatactagtcacatgtgacaatttttatgtgtttctcagtcagtcgggaaagtgaatagcttaacttctttttaaactattttaaaagactcaaataatttaaaacagacaattttgacattatagtacaggatatttgattccatgaaaaccaagatttgataatttgaggttctcaggaagaaaattctcatgatttctagtcttcctggtgtgattacagaataaaataatgagcatttttctgttataaaaaattgaatataggcatacactgtcagttttgtttataaaatacctcagtgctgtgcaattgaactatgtgttacattagggaattggccatagcctgctctcattcatcaggcatcttccttctgcctgatccctaccagggctctctgaagaacaggctgagctgattgcttctgtgacactccctgcttcaattttctttttctgttctgtagggtgacattcatttcattttttttccacaggaaaataatcaagctatatttatgcactcttatttctgttacagtttataactaagggcttgaagcaaacaagaaattatttggcagaaaatatgaggcaacctttcataattaccacagcatagaagatctacatgctggtgactgacagctatgtgcataaagtgcttaggtgcatagatcaaatttccaggaagtcaaatatatttcttctaaaatatatatatatatgtatatgtgtatatatatatatgtatatgtgtgtatatatatatatatatatatatatatatatataatttttttttttgagacagtttcactcttgtcacccagctggagtgcaatggcacgatctcagcttaccacaacctccgcctcccgggttcaagtgattctcctgcctcagcctcctgagtagctgggattacaggtgcctgccaccacacccagctaatttttgtattattagtagagacagggtcttgccatgttggccagggtggtcttgaactcctgacctcgggtgatccacccgccttggcctcccaaagtgctgggattacagacatgagccaccgtgcccggctcctaaattttttttattactgtattatataattttaatacaaactacagttgagattttaacttatatttcaatgattcaaacagtgctacatgtttcccctcccccttcatttagatcagatcctaacttcttcactacaatccgaatcaatcaatgcctacacagcattattagctaactaggatagcctctgtccacagagagactttcagttagtgaaataataaataaacatgtaattattgatttttcaccaactatccagcacaggaatgatgcagctgggaatccaaaagaaatggaaagaatttatgattaatcttgttgagggacaagattaagattatgaaattgctgctattctaatgctttgatttatgaaaatggtaccttcatataattcaaagcagtgattgtaaatgacaaaacagtatttaattagataccaaattataggataaaaccacaagtgctatgtaggctttgtgtaggtagaatataagagatccaagtttgtcagagaacattacatgaatgagtaggtactgggagaggtaaagaggactagggcaggaattccaggcaagaggaagcttgacggtggactgaacgagagcgatggatctcaggtagcatgaactggttgtttatgcactgttggagtcgagaagctgagcctgggcgggggagaatggaacagcaaatatcagctgggctgctgtagcactaattgtggaggattgctcaaagtgaaagggaaggatgagaaacacattggaggatgtgttctgttctctgacggttctcactggatgagatttctactttctgacttccacgttttctatcacttacgtatatctttgcattcagtgctatttatattccagatacgtattagacattgtgatagaggttgtgtgtgccagacatggttcctggtttagtgttgttaattaacaaaactttaagtacctgtgttttgcttttctaaattgattgtaagttttaccacatcagggaccatgcatttttatattcattctttaaaaaactgttgagtatttatatgtgacagccactattgatataaaaggaatgtagtggttctggtttgcaagatatccagatagtttttaaaaggtatgagaattgttaccaatgaactgcagtgagattaattgttaaatttttctggaagaggctgggcgcggagtggctcacgcctgtaatcccagcactttgggcggctgaggtgggtggatcacctgaggtcaggagttcatgaccagcctgaccaacatgatgaaaccgcgtctctattaaaaatacaaaaaaacctagctgggcgtggtggtgggtgcctgtaatcccagctactcagaaggctgaggcaggagaatcacttgaacctggcagatggaggttgcagtaagccaagatcctgccactgaactccagcctgggtgacagagcgagactccgtctcaaaaaacaaacaaaaatttctggaagagttaaagactcaaagaagaatgatcttttgagttgagacttaaagggcagtgttttggaggcatgcctatgaagcatgggtggctcaggaaggtggaacagcctgcacagaagtgggggacacagtcacatgacacaggatgtacacatgtgctaatattgccaagtatggggtggaatgaaaccaaaggagattgtgcaaatgggtaggggcttgataagtgtctttgtatattatgcagaggagcttaggtggtatgctatgatgaaacatgttgattagctaagaaatgtttggacttgtatgttagaaccatcccatgtaacaaagaggagaatagaggggaagaaggacatgactgagcggagagactagaaatgaggctattgctattgcaatagtgtgtgacagagaagccaggagcaatgagaatagaaagaaggagaaaaaaacaaaaagtaactggaaagtaaaatggagagatcttgtgtttcatagaacatgggggatgaaatggagagagaccaggacctcgtctgtcttgttaataactgcttccccagcacctaaaagaaggccttatctaggtgcccaaccaatatttgtccaaatgaatgaaagggaaaaattgagatgattcctgggtttctggctgaagcagaatgtttataacagttaccaacagaagggatacaggaggggaagtcatgtattcatctgtggactactgtgggatatatagggtgggttctagaagagccagtctctaagatgtacattacaagagagtggagggcaggaaaggaagagaagctaatgaagaaaacaccaaatatgactgcagaagcataggaagaggcttaggttaggtaaaaatcataagtcaaagggacattttcatgatgaagtgtttgacaggatatttccagagagctcaatggtggtggcagtatttggtggcagtatttgcaaaatgagtgttcagctttgaaagactcagagaagactatcatcagtgttgtccccttgcttttttatggacatatcagaaattagaggttggcttactcaagttattttataaactctgggactttgtgcatctcttcacctgaggaagataaaggcagcatatggtatggtgatttttatagtaacaaccaatatgtaggttaaagatcaatattactaggcaataacatctaaatgtatatgtactactataataacattgacttgggtcatttcttctatagaatagataattgtaaattgtatggttaataataacgatatgttttaaaagactcacttctttaattcatagctttatgctatataaattgatgaataatccctatatatgatattatggccaataattacataccttagtccatacttgcatgtggtctaatttagctggctcctggagattttcagtagttgccttcaaatattacttgcataaggaggggaagaggagggagagcattaggacaaatacctaatgcatgcggggcttaaaacctagatgacagattgatagatgcagcaaactaccatggcacatgtatacctatgtaacaaacctgcacgttctgcacatgcatcccagaacttaaagtaaaattaaaaaaaaaaacaaatattagttgcataaaaagcacctaagattcttgataaaattttattttattttattctaatttttgattcaagaaggcctgggaactagagttttaacaagcacattcatgttattttaatatatgtgtgaagagctcttatttggagaaactctatcttaaatcattacacaatatgtatatattcaatatacatgattcaatatattgtatattgaaacatcacgttataccccataaatatgtacaattattgtgtccatttaaagaaaaagctctttagtatgatttgtatttttcagctggtcttcttgctccctcatgtggtgcaatgtgcaactgtatgttttagagctctcattttcagtttttagaaaatgaacttcacagtttatcaatctgttatctaacctttatttaaccatgcaataaacctataaatgcaaatgtagaattagcattaattcctctgcatacaaagcaaaatactagagaggactagaaaatgtcacatgtaagatttcacaatttagaaatgaggtggctaaaacattgctttatattttttatgtgtgtgttaaagattttgaaggagaatttggtagatgcgtactaaagggttttggtggcagtatttcagtatcatggtccaggtgtttgtcttttgcttgggttctccctatttgactctatcaggatttagaatatctgttttgaaacaagacagacctagggtctgcaatattcatttgaagttttcatttgccaggcttttttttttttcaaatcagaagggtttaattgataaatatatgataagtggtgtgcagagtaaagggttaggagtaggaattctttatttcccttcctgcgctatagtgggcacattcatagatatttattaaaaccattggagagaagctttgtgggtgatacagtgataaatcaccatttctataagtgagaagagaaatttagaactttgcagccagccaaagcctgtaacaaaggctccacatcctaatgcagaacaggctgtccatgctcagacaaaggggaattgatggaagagttgcgaggaggggaaccgctggggaaatactaatagaggacatagcatttgaactgagaatccctaagaatgaccactctttaggaatccttgtgaagctctgttgtggacttatatctcatgcaattatttgttcttattgtggttattttattcattcattaaatactgattatggtcagacactgggctaagcatgggtgtataaagttgaacagggctgacttgatctctttctatgtaaagctcccattctgttagtgaaaacagacaagaaacaactatattaaaaataaataaaaggatactaaattaaagtaatggcaatgaaggaagtaaataagaagctgaggtagagaataacttggatggggtgggacaagacttactttggtgaaggtggctacagaaggcccttttgagaaaagatacactaccgtgtttattgagtacaatgattttttttctttttctttttcttgagacagagttttgctcttgttgcccaggctggagtgcaacactgcaatctcggctcactgcaacctccgcctcctgggttcaagcgattctcatgcctcagcctcccaagtagctaggattacaggtgtgcaccaccatgcctggctaattttgtatttttagtagagacggggtttctccatgttggtcaggctgctctcaaactcctgacctcaggtgatccacccaccttggcctcccaaagtgctgggattacaggcgtgagtcaccgcgcctggccgagtccaacaatattttaagagcttcccatgtattaagttcgttattcctcacaacgctgtaaggaaatacactgttactatactcatttgataggttagaaaatagaggcacaaagacattaagtaacttgacacataatttgcacatggtggagactgattcatgtctacatcaccagtctctagagcctgctcccttgaccactatgatagctatttcctgtcaaggctgaggaaaaagcatgcaccaaacctctgagacaggaaagcacttggtggttaaggcactggaagaagagctgtaggagaaaagcacagagatagtgagagtggcctggttgtgttcagagatgcagactgggatctgatcctgaaggccctttgagaacatgataaggaggtttggattgcattctaagtgcagtaaaaagccacagatgggttttaaacaaggttcagacatgatctaataaaccttttaagaggctaactcttattacaatgtggataattaattgcaggcaggaaatcagtagggagaccagtcaggaagaggtcatgaggtttcagcatagggatggggaagagattcaaacaaattttggaggtagaatgaatagtactttacatgatagagtaccccatcctagcagacatggtgggagtctgaaataccacatttcatttggggtgtaggctcctttcagacatatgctgatacagaaaagagtgtttggtattaagagacagtcactgattgagttgaaaaaaacagaatatgttatttaccctagcaccgtagaaccactgacagctgagagaaaggtctttttctgttacaatatgttgatctcacagatgaaaacactgaactcagagaagttaggtgattaattgcttaactgttgattgcagacttaaaagtaaaacataggtaattttccttgacttagcacatgcataactagtttctacttaagagagacaaatgtaagttataagttgatttcccaccaattccagggcactagagtactttgttacaggctgagtactttcttaatttcttgctcctttaatttagaatggttttctttgagggcaacaaccatttccattttataacacatggaaaaatgagaatttcccttctctcttcagacatggaaacagaaagaaacagaggaaaggacaaatcaataaacttacttcccatgtgacttggtcaccttccctgtcctcatgtttgcctgtaggaattttttcttttgattatgaaaggtagctgatatggttaggttttgtgttcccacgcaaacctcatcttgaattgtaatccccataatccccaggtgtcaagggagagaccaggtggaggtaattaaatcatgggggtggttttcctcatgcgttctcgtgatagtgagtgagttctcaggagatctgatggttttataaggagaaattctcccctttactaggcacgtcttcctgctgccttgtgaagaaagtactctgcttcctcttccccttccaccatgcttgtaaatttccggaggcctccccagccatgctgaacagtgagtcaattaaacttctttcctttgtaaattacccagtctctggcagttctttacagcagcatgaaaactgactaatacagtagccctgatgcaaagtagagcttcagaaaggatcagggaactgctaagtactttggactacagcgaacatgctcaaggcagaaaacaggaggaggctgcatctaggcaaaggtcttttttttaccacagccaattagagtgtccctgaggaatctctaaagtattcttaaaggagcgaggcaagtcctagagggttcagttaatcttaccatggcctttctgtccagtaaaaaatatcaagttattttgcagtgctgagtggttgtttgccagctgaaacttcaggtggaattcataatggaagctgatgtctgagatccgtgaataagccaggaatgaggtgtatccaaaggcatctgtgccactgaaccttggctgagtaatattaatagctgtgaaaaaacccaaaccaaacagttaaaataaacctgtacatgtatttgtaaagtgagggttacgttttgctgatgcatctggccagatagtctgtttactattacattaattatactttagtgcccttcagcattgagcaactaagtgactcaacaggaaatttcaaaaccagaacaaaggaaatgcagtgttttgagatcttctatataatcctttcactagcatactctttctacataatggataatttacttaaaaagcaaacccctatattttgaaacttaattttagaaatagaaaagattactggcagccaaacaaagtatttactcaggtgcctcgtaaacatgatttggcatccaaaacctggatatgacttagagaggagctcacacctttgaacaaactgtgcttttctaatcctgcacctttatctgagccaaagccccaggtcagggctaggaaagtcaagaaataggaaggaaatcggtcagttttctatcatcattggtgagtgaccagagcttttctttaagtaaaaataattgtctaaaagaaatgttcattatttctttgctgagatgcttcttaagtaataaaaacatggaattcaattggtgtgaaagtgtagggagatttattaaaaacaggaaatggtaaaattagatgaagttcaagggccagtgtgaacaaaatagaatttaactgagggttgcttcttgtatcgaactcttctctttcattgtactgtttccttcataagtctccactggttttttaaatctccttacccaaagaggacaacagaaaatagaaaggggattttgacaccccattcctgtcttttatggatgatgtcaccagattaagggatgttcctaggatctatttttattggttggggacagctcggttgaggaaataagagcttatgttgtttccttctcaagagatgttggaactccagggaagctgtaaaattagaatttttacaagccttaagaaatatactcactctggtatgtaacacttaaaagagcttcttatgtctgtttataattgtgtatacagcaaataatttaggaaaaatgatgcttattatcaaaggcttgtatatctttgttttatatgactattaaactaagatatttgtgtgaataaactgaatactttgttttgatattttattaaaatcttatcagtttattatgactattaaactaagatatttgtgtgaagctgaatactttgttttgatattttattaaaatcttatcagtttattccctgggatgtgtggcataggttaaatgtaattttctcaaaactcaccagaatgtgaagtagggacttttgagacatattgcttcttatacttattttttaatctaatgaaaactttataatttgtgtccctgagataataacactctcaggtatatcactttcagtagtactatggggagggtgattgagggaaatgaaatgtactggagttgaaacagaataaaaatactgaccatcattcaatgttggcattaaaaactatgaaaatagaattcagttaaatttaatactaaaatagaaaaggaatgactatcttttgcttttaatatttcttcctgttaataatttacaactgagtctacctaaaggttacatttaggctagattgacaaatacgtatctcatatatatggtattttactgtcagaacctgtgctagatgctggtgacacaaagataaaaaagcactagtcactcaagggattagtgtgaagtcaatacatttattcagctgaactggactgaaagttgaggcctggtataagaactttcaggcagaagaaacagcatgttctagggtgtgaagaccaaaacagcatgtcatactcagggaacttatgaagtctgcaaattttagaatgaagaagaaaagtgagagtggaaggaaatgaaacaagatagacagtggtcaaatcatgaagaactatatattttctttattatcctaaagtagttgggcaatgatcaaagttgctttttagaaatattattctgttgatgaagtgtgaatcatagattagacagagagctggaggaccaaactttggtcaaggatgaaaataagaactttgatatcaagaaatctaacaatgaattaagcttatgcagaaatctaaatgtaaggcaatttatgagtaactcattaaggcaatggtgtgatatttaaacagctaatggaaatacattatcagtgcaatttcatgatataatttttactatcaaaaataagtacttttgaagtttgagaataataatgaagactgatgataaccatgacccataggaatggatctgtcaaatgctcagcatttcttagtctagtggtacctgcagctgttgagcatttgaattgtggttaggcctgtgtgggaagggctcagtatgaaacaaagaatgtaaaatatattattaataacattcccatatccgttaaacattgggttaaataaaatatattactaaaataaatttcacctgtttcttttaactttgaaaaatgtcgctactagaaaacaaaatgacataggcagctcacattctatttctattgaatggcaacgcagagagatccaagcatgttttgataggttaagttcttcctctaaaccgttagttgtgacttacttcaaggggctttttcttttggtaactttgaacctataaaaaggtagggcctctgtggggagcaataggaatcaggagaagaggtcaaagataatataatccatcactaagaggcttctatgtctgcacccacactgtctctataactctgaattaggcagaagaacgtgagggactcagactaggagaaagaagactttcaaccttacaaatcattcttttcaatactttaagcccttttccatcttccgccaggtaacatttggttaatttggttactctactgcataaattcccagatcagccttctggaaggatcagtcatcatctaatcaggaaattgaacagattgtaatgggactatttttgggctattaaatgtatatatttttttaatttttgcaatccctagttgcctcacagataccatgtgtaaagtcatgcatttttttgtcagttcttctaaagttacatgaatgaattggaaacatgaagaaaaaagggagatgctggaatttaaactaaaataaattgtttagtgtgtagaagaagaaagcaaaatcactaatgctctgggatcatttcaggcacagtcaaaaggtatccagacatcatctcggggcattaaaaattctaagagccttgagtaaagagggaatattgtgatattttcttttatattatagtgctatattataggctcaatgtataatctttttaaaatgttatgcttataaaacacttcttagcaaaagttatcacagaaagggtataaaattctattttctaatcatttactaaggcaaatttttctcattcccaatatggccgagaaataaggcattattgtgtttaatgtgactattttttccttttaaaaatattttgctgtggccgggcacggtggctcatgcctgtaatcccagcactttgggaggccgaggcgggtggatcatgaggtcaggagatccagaccatactggctaacaccgtgaaaccccgcctctactttaaaaaaaaaaaaaagaaaaaagaaaaagaaaattagccgagtgtggtggcacgcgcctgtagtcccagctactcgggaggctgaggcaggaaaatcacttgaatccgcgagacggaggttgcagtgagccgagatcgcgccactgcactccagcctgggaggcagagcgagattccatctcaaaaaaaaaaaaaaaacaaaaaaccaaaacaaagacaaaaacaacccccccccccaaaaaaacctgcggttaatcttttaatctgaattattaaagtttatgcacaatgcacagaagtggctaagatgaactattggaatgtggaaagaagacatataaatagttcagatttcagaacacctttcttcaactctgcagtgatgcatcctgaagcccaccggctggtagtaaaacatgagctactctatggcatagtgatggagggaggcagctggggctggccagctcaggcttgattctggatgtttttactttctgtgtaaacttgggtaagttatttcacttttctgttttagtttctttgttcataaaatgagaatgtaagagcacctaacatctgtgaagaatgagaaaagcccatggctgaagaaaacacactcgagctaaacatacaattcaagtgggcaaacctcttccaccataccagcaatcctactacatatttccagtcaagtcactttcccagcctctaaaatggctatttaatgcttcctctctcctcaaacatctaatatttattgtctcttatgaattaataatcttggtttttattttgctgagaaaaacccatcaacagagaactacctgatgctttcactgtcaaattctcccacccacaaatctttaatttttatccatatgctttgccttccctctgctgacaaggctgactctgcccgggtatttcatccaccccttctcatttgctcaagggcatcatttcagaaattctgtcctgcctcccaggagttaccaaattattcttctctactgcagcattccctttaacatgaaatatgctagaatgtccccatcataaataaagagcttccctccactccacattcccctctagctactgcatgtttctctgctcaacatactatcaaggggcttctagagagttgtctgtattgactcttacaaaatttattaccattcatgctcgattttattccagtcaggctatcttctctatcttttctttgaacttttgtatgttaagatcactagtgaccacagtctttctaaactaaatgtcaattctctgtttttatcttattcagtgtctcagaagcaactgacaaggttgattatttcttttctcttgaaatgctttctttacttggtctccatgaccactgcactgtcctgatattttttcctaccttaatgactgctgctcctcattctccttttcttccagttatctccatctaccatcattctgtatttgatcatgagtaccgtttacaggtggatgagtcctgagtaaacagtctctatccctgcttttttccagagctccagattcacatatccaaccaactactagataatgaacatatatttgtatgtctgataagaatttcaaactgatcatacacaaagcaaaactctttattccactatttgtattctttcccccaacccaaatcccttcccttcctttgcaatcaaatctgtttcccagccttccctctctttgctcagagcaaaactaggcatcatccttaaatggtatctttctctgctacctcaactgacaaactgacgaatatgttaacttcatcttcaaaatatatcccaaattacactgccgcttttcactgtgtctgttaataccatcaacgttcaatgcactgttctttgtagcccaaactataatatttgcttcttagctggtctccgtgttgctacctttatcactttacaatctcttttccgtattgtagccaaagtggtcttttaaatataaattgagtgtcaaagtttctccagcattttccattgaagtttgaaataaaatcaaaactcctgaacatagcctaaatctcccaatctccagatttattttatactcgtttcttctttctcattctgctgcagccatgctaacttcttcgtgtttctcaagcaaacctaacacactcccagttcaaggcttctgctcctgttcccggtgcctgaaccacattttccccaaaagctgcatggcctgctccctcacttccttcaagactcgctcaggtgttctctcctcacagggcctttcctgaccaccctattaaagtattaatctcctattaaagtagtaactccttgtgccctgcccttcccaaccccgtactctctagtctcttaacctgctttatttacatggcccaattccattatatgttatttgtttactttttattattttttctccccactcagattgcagattccactagggcagagagcttgcctgtccttcatggtctaattgggcataagatacatatttatcaaatggttgaatacatgtaaaaggttaaagtagtgttaaggacatagtaatatatattatgatagtatatctctgccattactgtttatctagtatcttcacaactctgttcttaagtgactaactattctgcacttatagagctactggatgaagttgtgaagtggatttctacactatcaccaatgctaatcattgcttgtttgaatttgttttttgtactaagtcctttcctctaaaaaatgttactaagtttttgcaataatatggaatcttaattcttctagtgtgggtaaaaattcagataatataatacatactgaaaatcaaggcatagggacccctaacctgacaaatcagtttattttttatttttttattttgaggcagggtctcattctgtcactcagactggagtgcagtggtgcaatcttggctcactgcaacctccatctcctggaatcaaacaatcctctcacctcagcctcccaagtagctgggactacaggcatccgccaccatgcctggctaacttttgtatttttttgtagagatggggtttcaccgtgttgcccaggctggtcttgaactcttgagctcgagcgatctgcccaccttggcctcccaaagtgctgggattacaggcatgagccaccaggcctggcccaaattgttgtttttaataattaagttgtataactagaactataattttatacattttgtcttataaacattagtttccatttaatatttgaaaataatgtcttctttaatttgtgagctaaaaatactgactaggtttcttgggacaattgatagtttttgacagaatattttgccttttacctgacaaaatatatgtatgatacctttaagatcatgcttaaaattttacatgtggtgttgaaaaaattttcttaagtgcatcaaaaattacttgaaacttttaagtgttttcaagatagattgtttggtctaaatatataattttttggagttcattgctgtttttaaacagatacaaaagacaaaaacctgtgggtgattttttcttggattctgttttctatgtaggctgctgtgtataacctcagcagagtggacaccagggagcgctgagctagtgaaaatccaattcagttcttccttctctatgatgtattttaatgaagcaagcagatggtaggtagatcttcccttggaaactgctgattttgaaagactccagaatgccagttttccaaccatcatgttcagcagtgtagcgtatcttgaaatacacatttaactttgccaggaaaattaatctacccttaggcagatggataaatttgcaaaaatacaagatgattgcttgcctctccagttttccttcctagctttgagtatacacgtctttcctctgtctttgttcttaacttcttagtaacacagcaccagatttagctcaatatcctgccgaaatgcaattaggttatcaaactatgtacgtggtcattgtctttgttgtttctgttttttgttgttgaacaaactccttgaggaatacactttcacactgttcagcattatcatttagaaataaaaatggcaacctacaaatgtgattattttttaaagggaatagaaataaatatgtccggagatatcgccaacagttataggtgatggtagcctgcacagaaaacatacagttaccttttccttctgaaccaagacagagatacccggtacatgaataaaatcaagctctctattcaaatggatatataatatcgaattcacccacaggtataaacatgaaataaatatgattggttggttgccaattcctgctcataataaattattcacgtattctatatagatatttaattactaccattctaacttctttatccaatcatcaagaaaaagctaagaacaaacagagttttacattaagatagaaaaactgttgaaaatgcagagcattataatttccaccagcaaaagaaataatacatgctagaatctgaagcattctttttagatgcataattcttagaaattagtgccatcttctggcttttcaaagtaactaggtactggtaggatgttttatagtatcacaaagtgtcagaaaaggggaaaaaatccctgaaacatataggttcaaatcataatcatagtatctgcaatacattacagttcatggcctaagctttgagcatggtaaaattttcacatcctctataattcatattacataagctgtgcaggtttatactggattacattcccttggttagtagtttattgtgataaaataagattcctagctattacacacacaggatattctggaactgatgtgttttgaataattttctcatttctaactcatgaatttcttcatgcccgtgaatatttagttcagaaattaagaaacattgaggttggagtgggttatcgctcaagttccgtggatacattcttttagtttgttactatatcatttttcaagatatggctgtttagatgcactattgtatattctaaaatattaaaaatagcaattatagtatctattatgtcccagctgctagatgccctatctaaattactttatttctcacagaacaccagtgagatgtacttctacctcattcctatcttatagatgaagaaattgaggctcagagatgttaagtcacagagctaagaaatgacagggtcaagatctgaacccctgttcatctgactccaaagcctgtgctctatgttacctacctcactatgatggttgggatactcatgacattggccagttaaaggccactggtaggtattttatgtaattattaaaatattacattattaaagttggcactccccacaaattgactatctaccactttactttcctcccaagtcctggccatggatgaataaaattctgtagaactcattcctccttctatatttaatagaaatgtaaacacatattaactactttgcagtgtcaagcatttaactgatattcaggatataccaatataccaatgaatttatcagcaaataagttttaatagaagctcaattgttttctaatatgcatagataataaataaaaaactggtttaaaagatccatatgtccttaaaggtttctaagtgcttgaacgtttggagacacaggcacacacatgcatacacaaatatacaggtcattgacaataatttttatttttgtttttggtattgtataaaagattaggaaaagcaaaaatctaataaggatgatttatcaaaaagcagtatgtactctaatcatgagagaaaaaagaaaaaaatcttaaccagggatactatagggaaaactataattttaagacaactgtggtttagctgttgaagtactagaagaaggcagtggcatcttgcaaaatactaactcatttctggggaccacaacaccacatgatgtttcaaaagcatataaaaagatttcatattaatatggtataagagattattctaagtaatactaacaaaataaaaatatcatacatgattcacaaggtataacatatattgagtactatttttaattggaaaggatcttgttatatctaatagccccaagattttgtgtactaatagtgagcaggtgcctatctcaaactataatggagtattatagaactacaaaagatgactggaataattaagaacaacaatcagaaaacataatgaaataaagtattttatttgctatagcatgaaatacttggaataaaactgtaccaattaggtttcttggttactggcaatataaactaaccctgaccatcttaagcaggaaaggagacagattacctcatggtcagtgggagggctggagaactagcagggaaagcaggaaaaacaaaggaacataggtagctcaaatactgccaagttcacattgtgtgaacagctatttcaggatgcagccactggtatttctatgactggggacagctgtgcaactacctcagctacaaataatttctaaatattactctctctctttggaccacttcttcagggtgcaaatcttggggagattatcccattggcttatcctaaggcatgtacatgtacgcaaataagaaggaagttcacgtgctacgtggccaaaatccaaaactgaaacaaacgtaatacccaataaatgtttcccacagacctttggttgctgagtgccaacgtgcatccttcttatacttgcattttcaaataacttccttttaacataatgcaacaatcccacatataatcaaaaaaagtgtcacccttctttcccaattggagacttcttaaagtcttttcttttattgcattttgttccaagtacagaaggaatctctgcataatggccatttgttctcatgtttatgttgtgatactgtcctgatatagactaaatttcagttactaaactcaaatgctttacagaaaccagagagcatatgacagctgtaatgtgatatggaagtatctgtgatttttcctggtgacagaatcaaaggtaatgctactattgtgcttttttgcttatcagcatccacaagagatagtcaaaaggaaagacttgatacagggagctaattatgaagggagagcaaacaggggatggtgaggccacctagaggatagcaacaactgaacagctgaaagcagctgctacctctatggctgaaagaacaaagggaagacacagtgctacaaaagcccaagagctgcaacctcctgacaggagctgggtccggtaatgggggctgctcatcaggacatgggaccacgggtagcttggggacctgttaagtggcagctggaaccaatcgcggatgcagctactagtggaggggagaggggagaaattctgtagcttctcttccccccagtctcctgtctcctgacaggaccttgccttggtaggagaaaatgtagtttgtacagggtgagaaatgcatctcagagctaacctgcaaatgactggcattcaccaggaagccctggggctaaactccagattcctggaactggtcataaggccacttctcatattagaactttcttctttggatgctctctcctttcacgtaggggaagcaaatttaaattctttcttctgtgtcctccttgcttgccgcctgccctgcagttggttggattctttatctggtgtggtgatgcaagtcatcattcctgagaggccaggccatggtgggcctgcggtcaggagcttcacgaggcctccattaactcttaccattggatgtgtgaagcactatcccaaggcaggcttctcactgtgtgtgtgcatgtgtgcctgttaatgtatgcatgtcatggacctctatagcagtctagggaagctagtgggaaccctcctcagaataatgtttttaaattcatacagtaaaatacctaagattataaaacaaatccacctttttgaaatacaattaataaattataacaaatgttttgtcatgaaggaaacagtatagtcctttcataatgtatttaaatagcaaaatctagcagcaggtataataactacagcagtttcacattgagggggcacaagcatattttaatacagtatataacaactgtcatttgataaaaagggatctgatttctcttggtgacaaagttgcaggtgctgataatacaactgtgattttatgctgattttcatagttaagaatacattaagtttctgttggagttcacagaaagatgtagtttttttttcctcatccatattcacagcttctttgactgagagggttacctgggttttaccagaacactttttcacctgctggctaattctctcaccttcagtgttttttcaattccacccttctccttctccctgaggcctatcttgtcctatcctgtacactctatttacttctaaccttcctctgtgtggtaaggttttttaagaaatgctgtcttaaacccagtctggggccctggttggaggctagtcatttccctggactctcacattccaggccaccacactcctgtcctaattgccctgggacaggcaccagacaactagggacacaccttggagccctcagaattattccaattagccaatctacagagagccctcaaaacctaactaaccccacctgacttgccacacaaaagccctttccaagggaaacctccgtgtggccctgtggcagtcttctcccatttgaagctgtaagtaacaaaaagttctgccattcatctatccaagtgagttgtctccttccatccaaaaatatcttgaattcttataaaaacaccttgatcccctcccagggatttcttctctttttcttctcagcatttttgtttttgtttttccatagcacttataatctaccttctcacaaatcactagactgtctccccacctcactgaaatgtaaggtccgtgaaggcaggattttgtcatttttgttttctgctgcatcctaagcacttggaacagtgcctgcccataggaggctctctttattgaatgaataaatgaatgcatgactctcctctctgtgcctattgtgatcagtcactcggggcaacaccttcaagccccttcatacctgtttgtgtggtttcatggaagcctgaaagggaggtggatgatgtaaattctgattcaataggactatggctatgtctcttgagagctttacccttttgggtgccaaaagcctctgaatgagtggagctcagagtcacagagagaggaaaaattgtgagtgggtctttagggatgatcacgagacagactgctcttctgctcccccttggtttctgaatctgtgtagtatgattgtggaaaatatagcaccacgtgtcagttaaagtttcacagcatacatgacatctttcagaatggtgctgttaccctgaaggttggcccagttgatgctgccacagagtctttaatatacgatatttctattttataaggccaataacttttgggtgataaatttcataagttcagtatctctccctgccttatttctttcactgtgaagcctgttgtttagaagtaatattgtgcaggataccataatgacacactgtattgatgaactccctcaaaagaaatggtagaagaaccatgactagtagggaaagaaaatccaaatccagaacaagtaatcaggagaataaggacaaattcctgccaatcccatgatgtaatcaacctaccactaggctgactagtccccctttcatccctgggattatatcaggggtccgggttgtttgtagccatggggaaatgaggattcaacagtgacacttctgaagtactacttcttaagggaaagtccacattgaggccttgcatggcctctaattcttgcatcacagccatttccacatactgtcagattgcattctaaaattacaattcatgtttccataaaaaagtgcatataatcttcttgaattccctccagtaatttatatcattgctctttctaatttttgacagtctgatgagggtggtttgtccagttattactttaattgtatttccctgattactagtgagtttgagcaccttttacttgttggccaactgtatacccttcagtgagatgtctgttcatatgctttacttatttttctttgattttatctttattttgacaatactaaagagctctttgaatattatgttaatcctttgtcacctcacaaatagtttcttcaaatctattgtttttctactgactttagatgtgaaatcctttgcaattcaatagttttaaaaaaattgtccaaatgttttcttttacagctccagaattttctctcttggttaagaattattccttcatctctaggctattccaaattcttagatttggtcctgagatattcactgattcatgtttcatctttaagtctctaataatcccaggttttattttaatacataatataaaagaagcttaattttgttttcttccagtggagaataagttgtgccagtttcatctattaattaaaaccttatctcacaactgaataaaacagcaattttgtcatcaattgtactctcatatatgctggggtcttttgcttaattttctcttcttcctgttgatctatttgtatcttactatgccagtaccacactgataacgatgatagtagtttaacatatgttctgatacctagcaaggcaaggccaggcaaggacatttatttattttttatattttcactaggtattggtgggttgttgttatacatattattctagatcagactcaaaagctttgaaatgttatgaaattatgtattaaaatagcaattttctcatgtaatccataaataatataatttcagaaaattatattatgaattatatcttctcatctgctagcatggcaaagttttgtaagccattcatatataatattattaaagttttataattttctacatagaagtcttgcacctttctcatcaaatgtattcaaagtgttttgtaggttttttttttttttggttaaagttgtgactggaaaatttcttatttctaattctaggttgggcttgaaagtgtaacaagaggttaaaatagaagttctagctgaagcacaaagaaagtagaaacaacacatcaaagtgagggatttataaagcaggagactgaaaaccagctggtgactcttgaattcctcacccttattgagagtataaaaggcttatagccctcaccctttcacctcaaatcaagagggaagggttttagaaacacaacttggagagcttaatatgtatccctgaagtttgaggaaaggggacgtagtgtactgacttctgcctggaaagtctaacaggtgggagattaattgactgcaatgaaggagaaagccaatgacaggttgcttcttgactggaattgttcagcactccagaggctgtcagggaaaggatgtgagcatgctgcctggaatctgatgtggctcagctgtaggacaaagatagtgtgttttcttaagttctgaccaaatgaaccaccttaagagacaaagatcactcagcaaggaaagctgaagatgctatgagatgccagaggttggggaaggagcaaacaaccagctggaatggatatgccttttctcaaagaaaattgcaagtggaagaattccagccatggggtctccaaagcatccgtgaaactgttccacaagacaaggatggatgactgaatgccaaacccagagagcagtgaagctaaatcaactcaatcatttcagtgaagaaagaaatctcctgtcctttcctgtccctgaactccatgatgaagggccatgtgctgtaggtagcaaaacaggggagaaagaatttcagttttccttttcccttgaaattttctagctaaatcagtccgaaatgtggaaggaaaaagcatgaagttttttatttttattttttgagactgagtcttgctctgttgcccaggctggagtgcagtggtgtggtcttggctcactgcaacctcctcttctcgagttcaaatgattctcctgcctctgcctcccgagtagctggaattacagccgtgcaccaccatgcccagctaatttttatatttttagtagaaacaggtttcaccatgttggccaggctggtaatgaactcctgacttcaggtgtctgccagccttggcctcccaaagtgctggaattacaggcatgagccaccacacctggccacatgaaagcatgaaatttaatgcagatagatttacctatcatataaaaatggaaaaccgaattactaagtggaactgatattttgtgatccaggaatgaccatgtctgaactttcatttgaggggaaaaaggataattaacaccattgaacaaatttaaagggagaatggaagacaaagtaaagttgttttatgtttacatacagctgtgctattaagaaaagctaccgatttttattttttgtctcgtacaaatttttctcattaaagttatacaaccaacaaaaatagatttgtatcttcttttctactatgagtattgattatttttatctcattgcatttgcttggaccttctcaagaatatggcaaataataatagttatactaggcatccttgtcaagttctgattttaattgaagaggttttagtgtttcaccactaggaatactatgtgcttttggtttcaaactaggctttattaaattttagtattttattccagtttttagtttctgttttctaattttcttataaacaataaaacaattatgtctgttgaatttgattggatgtcttatttgtaactatctgatgacattttagtattgattaatcaaaaaatattttcctttagtttattttttgattttgcattatgttgataaatttcctagtattgaataaccttggtattcttagaacattcctaacttagtaataatatatattttggtacattgtttgattatatttgctaatatttacctttttctcccccctacaggcatttagtgaaattggtccatagttttattttcttctgctaatgctatgctgagttaataaaatgaattgagaagcactcacctttttctgtggtctggaataagtaacactgaaataatctgttcttaatacatacgatgaaatacttacaaatgtgcattattgtggtgacttttaaaatagtacatgtttaattacctttgaagatgctaacgtagcaattaaaaatgttttttcatttatgagtcaatttgaataattatggttttctagaataacattcattttctccaagtttcaaagtttgtttgcaatggacatgcatattttattctctaagaaaaaaatttctcatttatctatgattatgccacattctcatttctaatcatatttttcatctttttactctaatcataccttgaagaacttattttctttagctttaataataaccaagttcttttatactttatttatttcactttcatcaataattgcctttttgtaatttattttggtttatttctatgctttacatcttaaaatgggtacttcttatatttttatcttttgtctttttttctatttcatttgtttcagctacattttcaatgattcccctttcctaagttacttttatttgcattattgttctttttttctaatttgttaatatatgccccaagtccttacatttttcttctggattcactttcctccaattttgtctaggttaatctctagcctcttgcccaatgcaaaggaaagcagaatagatactccaatttctataactcaggaacctacttccaccaagcttcccactgacttcagaatatgcatcttacaagtgacagctagattggagttggaaataaaggaagatagcatcccacaatctcgtctctctttcatttataacgtaactataatatgtcacaggcaagttctaaataaagaaaaccttaaatcattgagggacataaagtaaattattagtaagtagaaatactttcaaataggaaattttaatataatagacatgccaattcccactaagtgattttatgaattcaatgtgatcttaatggaaacatgacggtatggagtgagtccagcataagacacaaatatacctggaagatttttactgtgagtggcttttcaaattaatgagaaaaaggaagatcattcaataaatattactgataaattgatcattaccacatattacaaaataaaacttagcttcataaaaaattaaatgttactgcaagaacaaaccagcaatccccagaggacccacagaccctctgaaggaagtggactgctgctgcaggacgcggagacaccccaaattctgtgagcaccccagctgcggaagtgggaaaaggagaccctcctctcccgagcacatacctccattggagaagctgaaggtccaggtccgtttgcaggagaagttgccgagtttacctggagccaagtcaagttagagagccgagccaagtgaaatacaggggtagaggaagcagcagaaaggccctgggagcttactgggtccccaagcagcccattcctgcctggcaccacagggatccatcaggagggtggccagaggaacgggggcaaaactccaaagggagaaggaattctgtagctgaactttgtaacaacttgaaccaggcgagaagcctcctggccagaacttgggggagggcgccaatcccgcttgcagagttcacaagcaggggaagaactaaagcccttttcttttgcagctgggaggcagaaatctggcaagttttcaagcccctctcacccgccacctgggaatagactcggggctgttgttgggggcatggtgggagtgagactggcccttcagtttgcatgggagctgggtgaggcctgtgactgctggctttcccctacttccctgacaaccttcatgactaggcagaggcagccacaatcctcctaggtacacaactccagtgacctgggaacctgtcccccatcctccacagcagccacagcaaaacctatacaaggagactctgagcttagacatgcctagccctgcccccacctgatggtccttccctacccaccctggtagtggaagacaaagggcgtataatcttgggagttctagggccccgcccactgcccatccctctccacactatagctgttctggaaaatgccacctctgggcaagaggccaagcagcacaaaaatagagcattaaaccaccaaagctaaggaccctcacagagtccatcgtgcccttcgccacctcaacgagaacaggtgctggtatccatggctgagagacccatagatggttcacattacaggaatctatgccgacaatggccagtatcagtccagagttaggtagactcgctggatggttagacccagaagagagacaataatcaccgcagttcagctcacaggaagccacatccacaggataaagggagagtactacatcaaggaaacaccccatgggacaaaatgatctgaacaacagccttcggccctagaccttccctctgacagagcccacccaaatgagaaggaaccagaaaaccaaccctagtaatatgacaaaacaaggctcatcaacacccctcaaaaatcacactagttcaccagcactggatccaaaccaagaagaaatccctgagatagttgaaaaagaattcaggaggttagttattaagtgaatcagggaaggaacagagaaaggcaaagcccaatgtgaggaaattcaaaaaatgatacaagtagtgaagggagaaatattcaaggaaatagatagcttaaagcaaaaacaatagaaaaaattcaggaaactttggacacttttagaaatgtaaaatgctctggaaagtcttaacaatagaattgaacaagtagaagaaagaagttcagagctcaaagacaaggtctttggattaatccaatccaacaaagacaaaaaataagaaaatatgaacaaagcctccaagaagtctgggattatgttaaacaaccaaacctaagaataatcattgttcctgaggaataaaagaattctaaaagcctggaaaacgtatttggggggataattgaggaaaactttcccagccttgctagagacatagacatccaaatacaagaagcacaaagagcacctgggaaattcattgcaaaaggatcatcattgcctaggcacattgtcatcaggttagccaaaattaagacagaggaaagaatcttaagagctgtgagacagaagtgccagggaacctataaagaaaaacctatcagattaacagcagacttctcagcagaaaatctacaagctagaagggattggggacccatcttcagcctcctcaaacaaaacaattatcagcgaagaattttgtatccagtgaaactaagcatcatatgtgaaggaaagatacagtcattttcagacaaacaaatgctgagagaattcaccattaccaagccatcactacaagaactgctaaaaggagctctaaatcttgggaaaaaaatcctgtaaacacatcaaaacagaacctctttaaagcataaatcacagaggatctataaaacaaaaatacaagttaaaaagcaaaaaaaaaaaaaaaaaaaggacaaaaacaaaaaaaaaatacataggcaacaaagagcacaatgaaagcaaggctacctcatatttcaatactaacattgaatgtaaatgacctaaattctccacttaaaagatacagaacagcagaatggataagaactcaccaaccatctgctgcctgcaggagactcacctaacacattaagaactcacataaagtaaagggatggaaaaaggcatttcatgcaaatggacaccaaaagcgagcaggggtagctattcttatatcagagaaatgaactttcaagcaacagcagttaaaagagacaaagaaggacagtatataatgataaaaggccttgtccaacaggaaaatatcacaaacctaaacacatacgcacctaacactggagctcccaaatttataaaacaattactaatagacctaagaaatgagacagtcagcaacacaataatagtgggggacttcaatactccactggcagcactaaatacttcatcaagacagaaagtcaacaaacaatggatttgaactataccttggaacaaatggaattaacagatatatacagaacatttcatccaacaaccacagaatatacattctattcaacagttctggaactttctccaggaaagaccatatgatagacaataaaatgagcctcagtaaatttcagaaaattgaaattacatcggccgggcgcggtggctcacgcctgtaatcctagcactttgggaggccgaggcgggtggatcatgaggtcaggagatctagaccatcctggctaacaaggtgaaaccccgtctctactaaaaatacaaaaaattagccgggcgctgtggcgggcgcctgtagtcccagctacttgggaggctgaggcaggagaatggcgtgaacccgggaagcggagcttgcagtgagctgagattgcgccactgcagtccacagtccggcctgggcgacagagcaagactccgtctcaaaaaaaaaaaaaaaaaaaaagaaattacatcaagcactctctcagaccacagtggagtaaaacttgaaatcaactccaaaaggaaccttcaaagtcatgcaaatacatggaaattaaataacctgctccagaatgagtatttgataaaaagacaatcaagatggaaatttaaaaaattatttgaactgaatgacaatagtgatacaatctatcaaaacctctggggtacagcaaagacagtgctataaggaaagttcatagccctaaacacctacatcaaaaagtctgaaagcacacagtctaaggttacacctcaaggaaatagagaaacaagaacaaaccgaacccaaaaccagcagaagaaaggaaataaccaacatcagatcagaactaaatgaaattgaaactaaaaaatacaaaagataaatgaaatgaaaagctggttctttgaaaagataagtaaaattgatagaccattagcaagattaaccaagaagagaaaaaatccaaataacctcacgaagaaatgactgacaccactgaaatacaaaagatcattcaaggtgactatgaacacctttaagcacataaactagaaaacctagaagagatggataaattcctggaaaaatacaacccttccagcacaaatcaagaagaattacataacctgaagagaacaataacaagcagcgagaatggagaaaatcttcacaatctatacatctgacaaaggactcatatccagaagctataatgaactcaaattagtaagaaaacaaacaatcctatcaaaaaatgggctaaggacatgaataggaagatatacaaatggccaacaaacatctgaaaaaatgctcaacattactagtgatcaggtaaatgcaaatcaaaaccacaatgtgataccactatactcctgcaagaatggccataataaaacaaattttaaaaagtagatgtttgtgtggatgtggtgaacagggaatacttctacactgctggtgggaatgtaaactagtatggaatgtaaactaatacagaatgtaaactagaaaactgtgtggagattccttaaagaactaaaagtagaactaccatttgatccagcagtacccactacagggtatctattgagaggaaaagaagtcattattcaaaaaagatacttgcacatgcatgtttatagcagcacaattcacaatcgcaaaatcatggaaccaacccaaatgccatcaatcaacaatgagtggcggaggttccaagatggccaaataggaacagctccagtccgcacctctcagcgtgagcaatacagaagatgggtaatttctgcatttccaactgaggtaccgggttcgtctcactggggcttgtcagatagtgagtgcagcctatggagcaaggtggggtatcacctcacccgggaaatgcaagaggtcagggaattccctttcccagcaaagggaagccatgacagatggtacctggaaaattgggacactcccaccctaatactgtgcttctccaatggtcttagcaaatggcacaccaggagattatatcccacacctggattggagggtcccacgcccacagagccttgctcactgctagcacagcagtctgagattgaactgcaaggtggcagcgaggctgggggaggggcgtccaccattgctgaggcttgagtaggtaaacaaagcagctgggaagctcaaactgggtggaaaccactgcagctcaaggaggcctgcctgcctctgtagactccacttctgggggcagggcatagctgaacaaaaggcagcagaaacttctgcagacttaaacgtccctgtctgacagctttgaagagagtagtggttctcacagcatggagtttgagatctgagaatggacagactgcctcctcaagtgggtcactgacccctgagtagcctaactgggagacacctcccagtaggggatgactgacacctcatagagctaggtgcccctctgagacaaagcttccagaggaaggatcaggcagcaacgtctgccattctgcaatatttgctgttctgcagcctctgctggtgatacccaggaaaacagggtctggagtcgacctccaggaaactccaacagacctgcagctgagggtcctgactgttagaaggaaaactaacaaacagaaaggacatccacaccaaatccccatctgtacgtcaccatcatcaaagaccaaaggtagataaaaccacaaagatggggagaaaccagagcagaaaagttgaaaattctaaaaatcggagtgtctcttctcctccaaaggaaaacagctcttcaccagcaactgaacaaagctggacggagatgactttgacaagttgagagaagaaggcttcagacgattgctatttacagactcctcccagctaaaggaggacattcgaacctatcgcaaaaaagttaaaaaccttgataaaagattagacgaatggctaagtagaataaacagtgtaaagaagaccttaaatgacctgatggagctgaaaaccatggcacgagaactacatgatgcatgcacaagcctcagtagccaatttgatcaagtggaagaaagggtatcagtgattgaagatcaaatgaatgaaatgaagcaagaagagaagtttagagaaaaaagagtaaaaagaaacaaagcctccaagaaatatgggactatgtgaaaagaccaaatctatgtctgattggtgtacctgaaagtgatggggagaatggaaccaagttggaaaacactcttcaggatattatccaggagaacttccccaacctagcaaggcaggccaacattcaaattcaggaaatacagagaactccacaaagatactccttgagaagagcaactccaagacacataattgtcagattcaccaaagtcgaaatgaagggaaaaatgttaagggcagccagagagaaaggtcaggttacccacaaagggaagcccatcagagtaacagcggatttcttggcagaaactcttaaagccaggagagagtggaggccagtattcaacattcttaaagaaaaggattttcaacccagaatttcatatccagccaaactaagcttcataagtgaaggagaaataaaatcctttacagacaaacaaatgctgagagattttgtcaccaccaggcctgccttacaagagctcctgaaggaagcactaaacatggaaagggaaaaccagtaccagccattgcaaaaacatgccaaattgtaaagaccattgatgctaagaagaaactgcattaactaatgggcaaaataaccagctaaaatcataatgacaggatcaaattcacacataacaatattaaccttaaatgtaaatgggctaaatgccccaattaaaagacacagactggcaaattggataaagagtcaagacccatcagtgtgctgtactcaggagacccatctcatgtgcagagacacacataagctcaaaataaagggatgaaggaagatctaccaagcaaatggaaaacaaaaaaaagcaggagttgcaatcctagtctctgataaaacagactttaaaccaacaaagatcaaaagagacaaagaaggccattacataagtaaagggatcaattcaacaaaaagagctaactatcctaaatatatatatgcacccaatacaggagtacccagattcataaagcaagtccttagagacctacaaagagacgtagactcccacataataataatgggagattttaacaccccatgtcaacattagacagatcaaagagacagaaagttaacaaggatatccaggtattgaactcagctctgcactaagcagacataataggcatctacagaactctccaccccaaatcaacagaatatacattcttctcagcaccacatcacacttattccaaaattgaccacatatttggaagtaaagcactcctcagcaaatgtaaaagagcagaaattacaaaaaactgtctctcagaccacactgcaatcaaactagaactcaggattaagaaactcactcaaaacggctcaactacatggaaactgaacaacctgctcctgaatgactactgggtacataacgaaatgaaggcagaaataaagatgttctttgaaaccaacgagaacaaagacataacatatcaggatctctgggataaatttaaagcagtgtgtagagggaaacttatagcactaaatgcccacaaaagaaagcaggaaagatctaaaattgacaccctaacatcacaattaaaagaaatagagaagtaagagcaaacacattcaaaagctagcagaaggcaagaaataactaagatcagagcagaactgaaggagatagagacacaaaaaacccttcaaaaaatcaatgaatccaggagctggttttttgaaaagatcaacaaaattgatagaccgctagcaagactaataaagaagaaaagagagaagaatcaaatagacacaataaaaaatgatgaaggggatatcaccaccgatcccacagaaatacaaactaccatcaggaatactataaacacctctatgcaaataaactagaaaatctagaagaaatggataaattcctggacacatataccctcccaacactaaaccaggaagacgttgaatccctgaatagaccaataacaggctctgaaatagaggcaataattaatagcctaccaacccaaaaaagtccaggaccagacggattcacagcctaattctaccagaggtacaaagaggagctggtaccattccttctgaaactattccaatcaatagaaaaagagggaatactccctaactcatttcatgaggccaacatcatcctcataccaaagcctggccgagacacaacaaaaaaagagaattttagaccaatattcctggtgaacatcaatgtaaaaatcctcaataaaatactggcaaaccaaatccagcagcacatcaaaaagcttatccaccatgatcaagttgacttcatctctgggatgcaaggctggtttgacataagcaaatcaataaatggaatccatcatataaacagaaccaaagacaaaaaccacatgactatgtcaatagatgcagaaaaggcctttgacaaaattcagcaggccttcatgctaaaaactctcaataaactaggtattgatgggatgtatctcaaaataataagccctatttatgacaaacccacagccaatatcatactgaatgggcaaaaactggaagcattccatatgaaaactggcacaagacagggatgccctctctcaccactcctattcaacatggtgttggaagttctggccagggcaatcaagcaagagaaagaaatgaagtgtattcaattaggaaaagaggaagtaaaattgtgcctgtttgcagatgacatgattgtatatttagaaaaccccatcgtctcagccccaaatctccttaagctgataagcaacttcggcaaagtttcaggatacaaaatcaatgtgcaaaaatcacaagcattcctatacaccaataagaaacagccaaatcatgagtgaactcccattcacaattgcttcaaagaaaataaaatacctaggaatccaacttacaagggatgtgaaggacctcttcaaggagaactataaaccactgctcaacaaaacaaaagaggacacaaacaaatggaagaccattccatgctcatggataggaagaatcaatatcatgaaaatggccatactgcccaaggtaatttttagattcaatgccttccccatcaagctaccaatgacttccttcacagaactggaaaaaactactttaaagttcatatggaaccaaaaaagagcccacattgccaagacaatcctaagccaaaagaacaaagctggaagcatcacgctacaggacttcaaactatactacaaggctacagtaaccaaaacagcatgctactggtaccaaaacagagatacagaccaatggaacagaacagagccctcggaaataataccacacgtccacaaccatctgatctttgacaaatctgacaaaaacaagcaatggggaaaggattccctatttaataaatggttctgggaaaactggctagccatatgtagaaagctgaaactggattccttccttacaccttatacaaaaattaattcaagatggattaaagacttaaatgttagacctaaagccataaaaactctagaagaaaacctaggcaataccattcaggacataggcaggggcaaggacttcatgactaaaacaccaaaagcaatggcaacagaagcaaaaatagacaaatgggatctaattaaactaaagagcttctgcacagcaaaagaaactaccatgagagtgaacaggcaccctacagaatgggagaaaatttttacaatctacccatgtgacaagggagtaatatgcagaatccacaaagagctttaacaaatttacaagaaaaaaccccatcaaaaagtgggtgaaggatatgaacagacccttctcaaaagaagacattcatacaggcaacagacacatgaaaaaatgctcatcatcactggccatcagagaaatgcaaatcaaaaccacaatgagataccatctcacaccagttagaatggcaatcattaaaaagtcaggaaacaacagatgctggagaggatgtggagaaatagaaacgcttttacactgttggtgggagggtaaattagtttagccttgtggaagacactgtggcgattcctcaaggatctaaagctagaaataccatttgacccagccatcccattactgggcatatacccaaaagattataaatcatgctgctgtatagacacatgcacgtgtatgtttactgtggcactattcacaatagcaaagacttggaaccaacccaaatgtccatcaatgatagactagattaagacaatgtgtcacatatacaccatggaatactatgcagccataaaaaaggatgagttcatgtcctttgtagggacatggatgaagctggaaaccatcattctgaacacactatggcaaggacagaaaaacaaacaccacacgttctcactcataggtgggaattgaacaatgagaacatttggacacagggtggagaatatcacagaccagggcctattgtagggtggggggaggggggagggttagcattaagggatatacctaatgtaaatgatgagttaatgggtgcactacaccaacatggcatatgtatacatatgtaacaaacctgcacattgtgcacatgtaccctagaacttaaagtataataataaaaaataaaaaataaatgagtgtataaagaaactgtggtatgtgtctgtgtgtgtatatatatatacatatatactctctatatactatatacatacatatatactctatatatacatatatactctctctctatatatatatacacacacacacacacacatacaatggaatactacacagccatagaaaggaatgaattaacagtatttgcagtgacctggatgaaattagaaactattaattctttcgttctttaagtgacgtaactcaggaatgaaaaatcaaacatcatatgttctcactgatatgtgggaactaagttatgaagatgcaaagggataagaatgatacaatggactttggagacttggagggaagagtgggagggaggcgagagatttgactacaaatatggtgcagtgtatactgtctggatgatgggtgcatcaaaatctcacaaataaccactaaagaacttatgtaaccaaataccacctgtagcccaataacttatggacaaataataataaattaaatatgaaactataacagttttagaaataagaaccataggtcaacaaacttattaatccttctaactttgacataatagaaggaagtagaaaaaagtgataaatttggctatttaaaacttcttaattcttaaaactactgaaagccaaaaatgtgggaaaagaaagtcaaaagacaaatggattccattctataaatataacaaattttggttatatcatgtcaatgttcatctgttggcagacatttgagttgctcccattattgggctgttatgaataatgctcctatgaaaattattatacaggtttttgtatggacatattttatttctctggattatatactttggagtggaattgctgggtcatatggtaactctaacactttgagaaattgctaaactgttttctaaatttattgcaccattttagactcctaccagcaatgtatgaattactgatatattctgtaacatggatgaactttgaaagtattttgctaagtgaaagaagccaattacaaatggctaatggtttctggtaaaacagaaattctgtttgctcttaggtgaatgtaaaatttgccttttaccaaaaaaatttggtaaaatatttgtcttttaccaaaaaatgacatttctagcaaaataagaaaaagaaaaaaaagattaacagaaagttatttgcatcaacacagactgttctaggagcatggaattgttaaaaaaaattcaatattagtttaatgttagaaacagaaggaaaaaagtgagcataataaactttgtctattagaaattaatggtcagcggtagaaaaagtcattgttctaaaaagtagaaagaaaatatcaaatatatctatgtaaaaaatcatatggtatgggaagaaactaaggaacatttataaaagagtacagatttttaaaatattaaaaaaaattttttggcattaaaatggcaattccttttgcaccaaccaaatagttattgaaggactgggttcatgaagatctctgttgcttggggaatgaggacatagtcctcgtttgaccatagcacactcattaatgcaatttattcagtaaatatttagtagtctgctaacacagatgtaaaaatcatacacctaataactctgaagaacataaagataactaagacatagtccttggctataacttggccttgtatcattctctgccttttttttgaaatgaaaagaatattttttctccttttgaaacagttaatttgagggttgggactatttttgttttgtattctccacagcgtctgatactatgatgttccatcaattcacatgtgacattcaatcaatattttttgatagtactgtctcatattgacactgatttgaattcaaaaaaatatagaaacattttatgaaaaagaacactatattttgagtgattcctagagctgtaacttttatagtgacaatggtgactttgttttctacatgctactcataggctatccttctagagcaccctggttaaaattaaaaacagtttgcaaattgatggggattttctcatctgtgtagagaattttgttacggatttttttttcttgctgcatggataaaatcttagtgaatcatctaaaatgaggcagcttatctctgtttatgtcattttcagttagcattctgaagttgaggtggcaaatatatgtccagagagtgtcctgaacaagaccccagaaaggggtaaaaatatgttaattcataagtgattgcaatttaaccaaatggtactctaaccttctaattaggcaaagagataaagtgaaggttgataatttagctaattttttctatttaactttctattgaagtataacacatatccagataagtttacaaatcataagtgtacattctaaagaattaaccaagtgaatttattgtggtttcagtgtaactatcgtccaaattaagaactattggactctgttattattttgtttaggattttgtatcaatatttatgactggcttgtgatgtctttccttgtcaacatcaatatcaagattatattcccctcacaaaagaggttgagaaattttgtctcttgttttattcccttgaagagtttacgtaagattggaactatttcttcctagtcagaagagtttatcagtgaaggcacatgaattttgagttttcttgtcagaagattttggatgatgaatttaattacaggactgtttattttggtatttcttcttgtaagagttttaattaattttgttttactctgattttatgcactttatctaattttttaaatagattgataggaagtggttcatcatatcctcttaatgtctgcatgatttcaagtaatgtttacatcttatgtattttagaaaaaaattcccagataacaaaatatctgtcataaatgagtctggtggtgatacttgcttccaactgtgtttcttttcttttctttttttttttctgtcttttagcctgccgtgtaatttttcaaatgtgttaaaagctggaagtgatgtgtaataggaactaacataaatagacgttagtataaagatttatgtaaatctgattaggagctggattttgttaaacgtttgctaaagccaaagatgctaaaggcttcaaattcctctagggtccttgactttgccttcccctttgatctgggcttccctaagggcttctccagagacagtcggcatcttgaagctctttcagttgtgatccactattattatactgcggccctgtatatgtggtgataaggtgtggaggagtggaaatgttctatagtcttctgatttaaaccctgtcttttagtaggcagtgttccttcacaaaagtttcttagcatttttcccctgtaggtgagagaggaaggccagtgggggctgaagtgggaaacatatccatctcccacataggataaggccttttctcctaaagagtaggcctctcttggcttctgtgacaacttgcactccaggtttttatgctccctccatgaccacatcttctcagtctccctttcttctctatctaaattctagatattatagctctctctacagtctcttcataagtgatctcatatatttccatgagtttgaatactatttatacgctgacaatacccaattttttcttttattattattttaaattgatacatgataattgcacatttatggggcacagtgtgatattttaatacatataggcaatgtgtgattatcaaattgggaattagcatattcatcatgtttaacatttatcatttctttctgttgggaagagtcaaaatctcctctagctttttgaaaatatacaaaaaattattgttaattatagtcactctgtagtgtcatagaatgctagaacttttctctgctatctaacttttcttttgtatccattaactaacctttggctatcccccctctctaaaaccttttcagcctttagtaatcactattctactttatagttttatgagatcagctattttagcttccatatatgagtgagaacatgcaatatttatctttctgttcctggcttatttcacttaacataatgttatccaagtttatctatgttgctgcaaatgacagaattaatttctctttcaaagatgaatagcattccattgtgtatatgtatgacattttctttatccattcatctgttgatgggcacttaggttgattttatattttggctttatttatttatttaaaatattaaaatatagaatagaaacagggtctcactatatggcccagagtggttttgaactcctgggctcaagtgattctcttgcctctgcctcccaaagtgctgacattacaggtatgagtcacagtgcccagccttggttattgtaagtagtgctccagtaaacacgagaagtgcagaacatccctttgacacactgctttcctttctttggatacatacccagcagtggaactgttgaatcacatggcagttctatttttagttttttgaggaccctccacactgttttccacaatggctggactagtttacagtttcaccaacagtaatgtaagtgtacatcctcgccagcatttgttatttttcctatttttgataataaccattttaactggggtaagatgatatctcattgtggttttggtttgcatttccttgctgataaatgattttgagcattttttttaatataccagttgggcatttgtatatcttcttttgagagatgtctattcagctcatttgcccatttctttttttttttttttttgagacggagtctcgctttgttgcccaggatggagtgtagtggcatgatctctgctcactgcaagctctgcctcctgggttcatgccatcctcctgcctcagcctcctgagtagctgggactacagttgcctgccaccatgcccatcttattattattattattattattattgtatttttagtagagacagggtttcgctgtgttagccaggatggtctccatctcttgacctcgtgattcacctgcctcggcctcccaaagtgctgggattacaggcatgagccaccacgcccagccccatttcttaattggattgttgtttgttttgctattgagttgcttgagttccttgtatattctggatattaatccctggtaggctgaatagtttgcaaatattttctttcattctgtaggtcgtcatttcactctgttgattttttttcctttgcggtgcagaaatcttttagtttgatcgaatcctatttgtctatttttgcttttgttgtctgtgattttgaggtcttctctataaaatctttgcctagactaatgtcttcaagaattcatcctatgttttcttctagtagttttagagtttcaggtcttaaatttaagtctttaattcatttttagttggcttttgtatatgctaagagagaggggtctagtttcatttttctacatagggatatccagttttcccagcaccatttattgaagacactgtcttttccctagtgaatgtccttgcatctttgtcaaaaatctgttggctttaaatatatgaatttatttctgggggaatctattctgttccattagtcaatgtgtctgtttatatgctagtaccttgctgttttggttactctagctttgactatattttgaagtcagctttgttctatttctcaagattgccttggctattcaaagtctttgtagttcaacttaaacagataatttctagtactaagaaatataaagcatgttaatgtcaaatttaatacatatctgtgctaacggctcaaattataattgataattaacatatcttcccaagtgcttaggtttgtttaaatataattttagtcacatggtaagactagattaatgattcataattctatacttaagttatctttaaaaagatagttatttcagtttttgctaacataatcagtaatcatttctatattaggttttcctttaaatacaatataacagaatcattgtatttgaaacatattcatgggattcagagtaatataaaagttaaaaccacaggttttaagggttctaattacaactttgccactaattagccagttcttgtattagttacatatcttctctaatttttggtgttcttatctataaaatggggataatagtaatagctaacttttgtgaactttgggattaaatgagataaactgtataaagcacttagaacagtgtccgtattgcaagcattcaagacctgctaactcttactattttgtaatgaactgcaatgacttctttgtttcttcaccttttattttattttttatattatactttaagttctgggatacatgtgcagaacgtgcaggcttgttacataggtgtacatgtgccatggtgctttgctgcacccatcaacccatcatctatattaggtatttctcctaatgctatccctccctttgccccccgccacccaacaggcacccgtgtgtgatgttcccctccctctgcccatatgttctcattgttcaactcccacttatgagtgagaacatgcggggtttggttttctgtttctgtgttagtttgctgagaatgatggcttccagcttcatctatgtccttgcaaaggacatgaactcattctttttttatggctgcatagtattccatgtatatgtgccacattttctttatccagtctatcattgatgggcattcaggttggttccatgtctttgctattgtgaatagtgctgaaacagtaaacatacgtgtgcatgtgtctttatagtagaatgatttatcatcctttgggtatacaccagtaataagattgctgggtcaaatggtatatctagttctagatccttgaggaatccccacactggcttccacaatggttgaactaatttgcactcccaccaacagtgtaaaagcattcctatttttccacatcctctccagcatctgttgtttcctgactttttaatgattggcatcctaactggtgtgagatggtgtctcattgtggttttgatttgcatttctctaatgaccagtgatgatgagctttttttcatacatctgttgcctgcataaatatcttcttttgaaaagtgtctgttcatatccttcacccactttttgatggggcttgtttttttcttgtaagtttgtttaagttccttgtagattctggatattagcccttgatcagatggataggttgtaaaaattttctcccattctgtatgttgcctgttcactctgttgatagtttcttttgctgtggagaagctctttcgtttaattagatcccatttatctatttttgcttttgttgccattgcttttggtgttttagtcatgaagtctttgcccatgcctatgtcctgaatggtatgcctaggttttcttctagagtttttatggttttagttcttatgcttaaatatttaattcatcttgggttactgtttgtataaggtgtaaggaaggggtccaatttcagttttctgcatatgactagccagttttcccaacaccatttattaaatagggaattttttccccattgcttgtttgtgttaggtttgtcaaagatcagatggttatacatctgtggtgttatgtctgaggactctgttctgttccattggcctacatatctgttttggtaccagtaccatgctgttttggttactgtagacttgtagtatagtttgaagtcagggtagtgtgatgcctccagttttgttctttttgcttaggattgtcttggctatacaagctcttttttggtttcatatgaaatttaaagtaggtttttctaattctgtgaagaaagtcaatggtagcttgataggaatagcattgaatttataaattactttgggcagtatgaccattttcacgatattgattcttcctgtccatgagcatggaacgtttttccttttgtttgtgtcctcttatttccttgagcagtagtttgtagttctttttgaatagggctttctcatcccttgtaagttctattcctaggtattttattctctttgtagcgattgtgaatgggagttcactcatgatttggctgtttgtctattattggtgtacaggaatgcttgtaattttcgcacattgattttacatcctgagactttgctgaagttgcttatcagcttacagagttttggggcttattatctcaatagacgcagaaaagatcttcaataaaattccaacactccttcatgctaaaaacactcaataaacttggtattgatggaacgtatctcaaaataataagagctatttatgacaaagccacagtcagtatcatactgaatgggcaaaagctggaagcattcccgttgaaaaccagcacaagacaaggatgccctctctattcctattcaacgtagtattggaagttctggcaagggcaatcaggtaagagaaagaaataaagcgtattcaaataggaagacaggaagtcaaattatctctgtttgcagacgacatgattgtatacttagaaaacctcttcaccttttattttaagttctggggtacatgtgcagggtgtgcaggtttgttacataggtaaacacatgccatggtggtttgctgcacagatcaacccatcacctgggcattaaacccagcatccattagcaatttttcctgatgctttccctcagcccacacaccctgacaggccccactgtgtgttgttcccctccctgtgtccatgtgttctagtcattcagttcccacttgtaaatgagaacatggggtgtttggttttctgttcctgtgttagtttgctggggataatggcttccaactccatccacgtcccggcaaaggacatgaattcattcctttttatggctgcatagtagcccatagtgtatatgtaccatattttctctatgcagtctatcattgatgggcattttggttgattcaatgtctttgctattgtgaatagtgctgcaatgaacatacgcatgcaagcatctttataatagaatcatttattttccttttggtatatactcagtaattggattgctggctcaaatggtatttctgcctctaagtctttgaggaatgtccacactgtcttccacaatggttgaactagtttacattcccgcccacagtgtaaaagcattcctgtttctccacaacctctccagcatctgttgtttcttgacttcttaatagtcaccatttggactgatgtaagaggatatctcattgtggttttgatttgcatttctctaatgattagtaatgttgagctttttttttttcatatttttgttggctgcataaatgtccttttggagaagtgtctgttcatatcctttgcacgctttttaatggggctgtttatttttttcttgtaaatttgtttaagttccttatagattctggataatagtcctttgtcagatggatagattgcaaaaattttctcctgttctgtaggttgcctgttcactctgttgatagagtcttctgctgtgcagaagctgtttaatgtaattatgtcccatttgtcaatttttgcttttgttgcaattgcttttgatgtttttatcatgaaatatttgctaatgcctatgttctgaatggtattgcctagattttcttctagggcttttatagttttgggttttacatttaagtctttaatgtatcttgtgttaatttttgtataaggtgtaaggaaagggtccagtttcagttttctgcatttgggtggccatgaactgtaatgacttccaaggaaggagacacaaaatacagctgcatttaaaatgagtaagtttaactcataatttattttccctattgtaaacctaaaggtactgaagatgggggagcatttattccaactctttcattagctatgaagaaagtgagatgcaaggagtcaaagtgacttgttcaaggccatgtagctggttatttcacatctttgttctcaaagtatagagccttcccattacacaacactaacagttcaaactgccaacttcaatttaatcactataaaatgatgcaaggatttttttttttttggttaataaaactgtatctgtttgagtttgtttaaagagtgatgttcattaattaaggcatgcagatgttaaaggaataaaccgcagcaccacactgccctttactctagagaatggagggtgaaaaaaaaagaggtgttgttcttttgctttctagatataaggctgtgagtaacacttcttttcaattttacctagcagcacatttgggatgtaatgatttctaagtttgttcttaaagaagctgcttctttggaaatgggtttttgtctaggggacttttttttatcaagttataattagacttcacttaatacacccataaatttgtagccttttgtttattgcacaggtgttctgatattctcctgttccaacagggctagtttgaataaccaaaagagcttttagatattggcagaaaggcaccttaagtcctttaacttgcaggatgggaaattgtataattccctagctatcataatatgtgggagaaatagctgttgaggctttcaattttgcttctgctctactggtgtaaactaaaacgcagaagctcagaattcaggatcctaaagatgcacttttctcagaagtgtttattataacaagtcataaaggagagaggtttaatggcagtaagaaactggcaacattgtaaagggattttacaatccacaaacatacaacaaacctctgaaatatgtacttcctaaacattgtatttttaaagcttacatagacatcaaacttaaaatgcaacggatatagctatctcaggaaaaatcaactctccatagttaagaaagaaacaaccctgacgtgtatttaggggactcactcagcagggcagccactgtggtattcctccgggaagccccctttggtgtttgctgtcaacaaggtgcatgttaaggcatccacctggagagtgacagggatacactccaacaagcagaattatcagccactcaccctgatgacagctcttctttctccagagcttaaagacttggggcagacaaagtctcactttaacaatttcaagttggtttaatacacaagaacaaaaaaagatgagattcaaaaatacccttggccactttagaatggcaaagagaattacaaaatgtcattgttgaaactgaatcactaggtgcaatattcagatttatcctctggaaaagattggatgttccctgccaggtgtttaatcaagaatacaaatcaaaatgggcagtaaaatgcttactttcaaagagctgtgttaactttataatctactcacacaccagttaggctctatagtgactgactgatggcagagacagaaaagagttaattcactgctggcaaaaatcccttactcaggacccacacactatcttattagaacaagagaactacaaatagacctacatttgtctgtctttggggtcaataaaaaaaatttaaaatatattaatacatgagcttttgcaagctattcttgtttgcttttcaaactttttaaaaatttaaattctaaaatttattttttttaattctagaaataaatgtgaagcctggtttttaggaatacctgtaacaatctctccctaggaaaataaagactcacatagcccttcaggaaacatggataacattaaataattcatatgttttgagacatgagttatatttctgatattgggtatttataactcccttttgaagttcatgttcagattcagattttacaatatcaccattacagcaaaattgggattgtgacttgattatataagaccacttatccttacctttggacttatattttgtttttcagttaaacaaaggaaggcgtgtggaacactcaacattgtgggaaaacatgtagattttggatacactggataatcttaatgcaatgtaggtacacatgaagtcagaatttggttgcaagctataattaattttcagaaatactttccctctctccctctcctcttccttcctctccctttttctcttttctctcctccttgccatcccctctgtttgctctccctttctctctttttccaaattaatttttgtcttagaaatgcataatgatagacatctgagaagccagtggtaaagtcactaataatatacataagccaagagattattggaattacccagttaaattattttgactgggcaattctacaataactgggagtctttctaaaaatactctgttgccagactaatgtttttctttaagaaattgttttttgcctgagttgacaaaatcaatgaagctctctactttggaattttccaattacatgatgatgcctctaaaagtttcagtctattcaagtttagttgatcttatcaaaatatatgagaaataacttagtgtctatatttgtacatacccaattttatgagtgaagattcatattaaatgattttgtggctctttgtcaaatgttgaatacttttcaatgtacttaaaatgttgaaaagccatcatttggtaaaaggagaaataataaagcaagggtcaagtcatttgactcattgggaaaatcaaaacaaaccgagtgatatatacataatgcaatttgaagcattttttatttttattaaattacagcacagagaagggagtaaaagtggtttctgcttggtttaggctgaaatgaccttattttgttcttactgtttgagaatgcccaccataaatgaatacatttccataaaatgcccgtaaaacatacatgcatgtttaatccttgactttttacgatgagattgctgtattagctgaagttttagtcactcttctgcatccatagtcttaaacattgtattttcacaatgtttaatcttttccacatctctgttagtatgagcttagagaatttaagtaaacttaattgtattggggtctgtggatagttttaaaaactaaaaataagcaggttttaaatatgccactttggggattggcaagatggccaaataggaacagctctggtctgcagctcccagcaagaccaacggagaaggcgggtgatatttctgcacttccaactgaggtacccagttcatctcattgggactggttagacagtgggtgcagtccacggagggcaagcagaagcagggtggggtgcccctcacccaggaagtgcaaggggctgggaactccatcccctagccacaggaagctgtgaggggctgtgtcacgagggatggtgctatctggcccagatactatgcttttcccatggtcttcacaaccctcagaccaggagattctctcaggtgcctacatcaccagggccctgggttccaagcacaaaactgggcagctgtttgggcagacactgatctagatgcaggagttagttttcataccccagtggcacctggaaccccagcgagacagaactgttcactcctctggaaagggggctgaagccaggcagccaagtggtcttgctcagcggatcccacctccatggagcccagcaagctaagatccactggcttgaaattcttgctgccagcacagcagtctgaagtcaacctgggatgcttgagcttcgtcggaggaggagggttgttcaccattactgaagcttgagtaggcggttttcccctcacagtgtaaacaaagccattgggaagttcagactaggcggagcccaccacagcaccacaaagccactgtagccagactgcctctctagattcctcctctctgggcagggcatctttgaaagaaaggcagcagccccagtcagaggcttacagataaaactcccatctccctgggacagagcacctggggagaggggtggctgtgggcccagcttcagcatacttaaaggttcctgcctgctggctctgaagagagcagcagatctcccagcacagtgctcaagctttgctaagggacagactacctcctcaaatgggtccctgaacctcgtgggtcctgactgggagatacctcccagcagtggttgaaagacacctcatacaggagagcactggctggcatctgtctggtgcccctctgggatgaagcatctggaagaagctttactattctgcagactccactggtgatacccatgcaaacagtgtcaggagtggacctccagcaaaccgcagcagacctgcagaagaggggcctgactgttagaaggaaaactaacaaacagaaagcaagaacatcaacatcaacaaaaaggacacccacataaaaaccccatccaaaggtcaatagcatcaaagatcaaaggtagataaacccacaaagatgaggaaaaaccagtgcaaaaatgctgaaaattccaaaaaccagaatgcctcttctcctccaaaggatcaagacaccttgtcagcaagggaacaaaactggatggagaatgagttacacaaatggacaggagtaggctttagagggtgggtaataacaaactcgtctgagctaaaggagcatgttctaaccaatgcaaggaagctaagaaccttgataaatggttagaggaattgctaactagaataactagtttagagaagaacataaatgatctgatggagctgaaaaacacagcacaagaacttcatgaagcatacacaagtatccatagctgaattgatcaagtggaagaaaggatatcagagattgaagattaacttaatgaaataaagcatgaaaacaagattagagaaaaaagaatgaaaaggaacaaacagagcctccaagaaatatgagacaatgggaaaagaccaaacctatgattgattggtgtatctgaaagtgacagaaagaatggaaccaagttggaaaacacacttcaggatattatccaggagaacttccccaatctagcaagacaggccaacattcaaattcaggaaatacagagaacaccaataagatagtcattgagaagagcaacaccaagacatataatcatcagattcaccaagattgaaatgaaggaaaaaaaatgttaagggcagtcagagagaaagattgggttacccacaaagggaagcccatcagactaacagtggatgtctctgcagaaaccctacaagccagaagaaagcgggtgccaatattcaacattcttaaatgaattttcaacccagaatttcatatccagtcaaactaagcttcataagcgaaggagaaataaattcctttacagacaagcaaatgttgagggattttgtgaccaccaggtcagccttacaagagctcctaaaggaagcactaaatatgaaaaagaaaaaccggtaccagccactgcaagaacatacgaaaatataaagaacaagagcattatgaagaaactgaccaaacaatgtgcaaaataaccagctatcatcataatgacaagatcaaattcacacataacaatattaaccttacatgtaaatgggctaaatgccccaattaaaagacacagactggcaaattggataaagagtcaagaccccttggtgtgttgtattcaggagacccatctcacatgcaaagacacacataggctcaaaataaagggatggaggaatatttaccaagcaaatggaaagcaaaaagaagcaggggttgcaatcctagtctctgataaaacagactttaaaccaacaaagatcaagagagacaaagaagggcattacataatgtaaggggattcatgcaacaagaagagctaactattctaaatatatacgcacccaatacaggatcatccagattcataaagcaagttcttagagacctacaaagagacttagattcgcacacaataatagtgggagactgtaacaccccactggcaatattggacaagtcaatagagagaaaattaacaagaatattcaggatgtgaactcagctctggaccaagtggacctaatagacatctacagaactctccaccccaaatcaatagaatatacattcttctcagcaccacatcacacttattctaaaattgacacataattggaagtaaagcacccctcagcaactgcagaagaatggaaatcataacaaacagtctctcagaccacagtgcatttaaattagaactcaggattaagaaactcactcagaactgcacaattacatggaaaatgaacaacctgctcctgaatgactactgggtaaataaagaaattaaggcagaaataaataagttatttgaaactaatgagaacaaagacacaacatatcagaactttgggacacagccaaagcagtgtttagagggaaatttatagcattaagtgcccacatcagaaagtgggaaggctctaaaactgacacccaacatcacaatttaaagaactagagaagcaacagcaaacaaattcaaaagctagcagaagacaagaaataactaagatcagagcagaactgaaggagatagagacacaaaaaacccttaaaaaatcaatgaattggccgggcgcagtggctcatgcctgtaatcccagcactttgggaggccgaggcgggcagatcacgaggtcaggagatcgagaccatcccggctaaaacggtgaaaccccgtctctactaaaaatacaaaaaattagccaggcgtagtggcgggcacctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaatcaatgaattgaggagctggttttttgaaaatattaacaaaatagaaccctagccagactaataagaaaagggagaagaatcaaatatacacaataaaaaatgagaaaggggagatcaccactgatcccacagaaatataaactaccatcaggtaatactatgaacacctctatgcaaataaactagaaaatctttaagaaattgataaattcctggacacacacagacactcccaagtctaaaccaggaagaaatcaaatccctgaatagaccaataacaagttctgaaattgagaccataattaatagcctaccaaccaaaaaaagcccaggaccagatgaattcacagctgaattctaccagaggtacaaagaggagttggtaccattccttctgaaactattctaaacaatagaagaagagggtctcctccctaacacattttatgaggctagcatcatcctgataccaaaacctggcagagacacaacaaaaaaagaaaatttcaggccagtatccctgatgaacatcaatccaaaaatccttaataaaatactagctaactgaatccagtagcacatcaaaaagcttatctaccacgatcaagtcgacttcatccctgggatgcaagggtggttctacatatgcaaatcaataaatgtaatccatcacataaacagaaccaataacaaaaaaccacatgattatccctacagatgcagaaaaggcctttgataaaattcaacaccccttcatgctaaaaacactcaataaactaggtattgatggaacatatctcaaaataataagagctatttatgacaaacccatattcaatgtatactgaatgggcaaaagctggaagcattccctttgaaaactggcataagacaaggatgccctctctcaccactcctattcaacatagtattggaagctctggccagggcaataaggcaagagaaagaaataatgggtgttcaaataagaagagaggaagtcaaattgtctctgtttgcagatgacatgattgtatatttagaaaaccccatcgtctcagtccaaaatctccttaggctgataagcaacttcagcaaagtctcagaacacaaaatcaatatgcaaaaatcacaagaattcctatacgtcaataatagacacacatagagccaaatcatgagtgaattgccattcacaattgctacaaagagaatgaaatacctaggaatataactgacaaaggatgagaaagaccacttcaaggagaactacaaaccactcttcaaggaaataagagaggacacagacaaatggaaaaacattccatgctcatagataggaagaatcaatgtcgtgcaaatggccatactgcccaaagtaatttataaattcaatgctattcctatcaagctaccattgactttcttcacagaattagaaaaacctactttaaatttcatatggaaccaaaaaagagctcatatacccaagacaatcctaagcaaaaagaacaaagctggaggcatcacactacctgacttcaaactatactacaagtttacagtaaccaaaacagcatggtactggtaccaaaacagatatgtaggccaatggaacagaacagaggcctcagatattacaccacagatgtataaccatctgatctttgacaaacctgacaaaaacaagcaatggggaaaggattccttatttagtaaatggtgctgggaaaactggctagtcatatgcagaaaactgaaactgaaacaacagttgctggagaggatttagagaaataggaatgcttttacactgttggtgggagtgtaaattagtttaaccttgtggaagacagtgtggtgattcctcaaggatctagaactagaaataccacttgacccagcaatcctattactgggtatatacccaaaggattataaatcattctactataaagacacatgcatacctatgttcattgcagcactattcacaatagcaaagacttggaaccaaaccaaatgcccatcaatgttagactggataaagaaaacgtggcacatatataccatggaatactatgtagccataaaaaagaatgagttcatgtcctttgtagggacatggatgaagctggaaaccatcattctcagcaaactaacacaggaacagaaaaccaaactccacatgttctcacttataattgggagttaacaatgagaacacatggacacagggaggggaacattacacaccgaggcctatcagggggtgggtggcaaggggaggcataggattagcacaaatacctaatgcaagtggggcttaaaacctagatgacaggttaatgggtgcagcaaaccaccatggcacatgtatacctatgtaacaaacctgcatgttctgcacatgtatcccagaacttaaagtataataataattacaataaaaaagccacttcattgtttcctccatcaatcacagctagttgaaattatataataaattatgtatataatatatgctaaatcccaagcagtttaagcataatttaaccataatttgaaatcagttacttgaaatcagtcccatgaaatcaatagaaggaataaaaatctcaaattatgtttggaagataattgtctagattagtggtctccaagcttgtttaatcttgcttcacagacattatttacttaaaattctatacatcttctcatataatgtagacctcatgaaacccacaaaaaatagaaattaaaggatcgagataaaaagagaattaatattttcttccaatatcacaatggagtctgtatactccactctgggaaccattagactggtatactctttgaaagccttgtcatgtgagaaagaagaattccttggtttaatgctgttattgcaggaattcttagagtttttactgtgctaccgcacatggtgaattcctgaaagggcaatagagtactgtgtagtgatctaaagaaagacaagtcagagattccagatctgggtctgccactcatgaacaatatcactttagactggttatttaaactcactgaacttcagtttttccatctgtacaatggcaataatgatgtatctccttgggttattacacagattatataagaagatgaatgtaaagcacttagtccaatgcctagcttatgggtatcttatcgcactagtgtactgtgaaaaatacttctggaaatatttcagattagactattcactcactgattatattattaagatactttttaaaatttcacaaatacttatgattatctcctaagtataggtgtagtagtaggctcagggcaacagcatacatagctgaatattctgaaggacttttaaattatttttaactcagaaaaaaatttcagaacctaccatgtgtcagacaccatgtactgctctgcagatatgatgatggccgaggcagatagggtgtctaccttcatgaaacttagagtatgaggaaaggactggtatgatttatggccagtgtttacaaggtaaatgcaaaatagtttaaagagtgttctgataaagggtgaagaagatgggggctattgggttagctgaggtctgcccatgcaaaacttgcacatcattttaaacagttcttactttatcctaaggaaaataggccactttcaaggtcaaagggatgaagggacaaaatattagaaaacacacaatataagcatgtcactgaatataaacaaaagcttgaacaaaataacttcacagtttttcctgtggcaaaaatttactcagactctaattaattttttgtttcagtgaagttttttttttttttttttatgtatcacaaatgtgtttgtgccttccgttgcttgctaactggcaggtgcatcacattaacatagctcttaaaccaaccaagcagagcctgataggtgtggtgggatctgacagtattcatttgatatgaagcaatgactctttgctaaagggcctggactgacagacctgcaaggtaaaagtctctggtgagcttgagaataaactacagaggtttactttccacacatggtctgcaagaccaatttgccataagtatattcaggagagaccactctgccttctgtgaatatatagtctctctattttagacctttttaaaaagcaggaaatgcttctgtcggaagggagaattctgtgaggttgctaaataatgacaaagtgctggaataaacagaaaggagaacatttggccttgagagtttagtgttctactgacagtcagtgttctgacagaggcaaacagtcagagtttgatagtgaatagtctgttctctgtgtaaaagtggacaataacagatgtgtagctccctaggaattgagatgtaaaaatctgcaaactaatttggtttccatttagtgtaagtagaaactgcctcatggaaatagttttaagatgagaggtaatggttcaaaagaaatatataaaatatcttttcttattattttgctaacttagaaaaatatggttgtatatttttctgcttcccatgatatttctttggattaaaaaattttaacacagtttcactggattgcaaaaatgtattttataaacttataatttatcaaatctattagactgaaataagataaatataatacaagaaatcctggttttgtttgagaaggagtctaagagtttatgaacaaaatcagatacacttaataaaacatattgaaatatgtagttcagggaaatcttgacacttatatcacgattagatttagctccatataacagacaacttattaaaaagcagaggtttaagcaaaataaattatttctgtcattaacagaaagtttcttactgaacatttccaggctagtatggtggttttatagttaaggatttaaacttctttcatcattttgcttcaccatcttagcatgtatctttaattctcaaggtgacttcgtagtccgagatgacttctggaattcaagacatctcatggacattctagacttcagaaagaaggaagatttggaggtcatgctactcttcaagagattttccagaggtcaatataatactctaacacttctgcttacatctgattttccagaatttagtcccatggccacattttaagctctaagggaggataggaaacttagctgggtacattagtgacccacgtacaatcaagagtgcactaatacagtatttgtatctgtatgagatgagtatctctgggccagtgtccagaggattccctgaagtgcccggcttactcttcaaagccataagtactatttctctgacatgcacgcaattgctagctctgtcaagtggtagaactttaagtgtatgtttcctagggtgctccatgaccaccgtgtgatggggtccacgtgtgctcagtgtgcattttctggagctggagacttgaactggatgctactcaagcactacttgtttgccaataagtttgatgtggatgttgacctttttgccatccaatgctttgatgagcatctgagacataaaactttgaagacattacaacactgacaattacaggcaattttatgaataataaggaggatacacaaaaaatatccttatctggttcctcttccttgtcagcaagcatcgggaaaatggtatgaagtcctctttggggtggggactcttagttttcttgtcagagaagctgcatgttttctgcagaacaccattggctagatatgtgatagcattaaatgttcacctaaatttaacgtgagggggagtaaaagtagccttgaggccagagcaggtagcattctggaaagaggggaccagggtgcctggggaagaggccgatgcataaggtcagcctgttcaaagagctcagggacttagcaaaacgagaagatttcacctgtgccaaaactattaagaattttaaatgtgacaattttcctggtatcaataaatttatagcaacaaacaaccataaagatacaattgatctgatatgttgtattgaaatagaaatttgattttactgtaaattatttggctaggctggtcttgaactcctgacctcaggtgatccacccaccgcggcttcccaaagtactaggattacaggcgtgagccaccatgcctggcccatcaaagctattttttaagaactgaaatgtgtacactgaaatacacatttataagtgctgcttttaaatatgtgccaacctaactttttctctctacagatgctgaagtagagggaaaaagtgaaaggcaggaggtgctcactttttccctgagcaagaggaaaggcaacttccctcagttcttatggaataaaaagtgcaggccattcaaagtctgccttcaacagagagaaagaggaatcactttcttgagcactttttttctcattcctgtctccttgctcctgtctgggattaggcttgaccttttagtatttctttgtaacaaggaactggaaaataaagattaaaacatggtgggaaatgagggatactaagatgtgttgaacggtggggcaatcaaacagctgttgagttggagagagaaagctggatcatatcagagtggatgctatcaaaagagttatgagcttaacatgacagaaaattgcatgttcttgaaatatgccattacaaaatgtcagcctgacattaagctgctttatagaggtatcatgtccctaaatagcctggtgattattcgtgtccctggagctctactttcctccctgattttgtaataccttggcttgtctttaatcactgcagagtgtcaccatcttagaaaaattcttaaaagaaaattaattttgatttccattgatgtcctagagagttttttttttttttttttttttttttttttttttttaatagctgggatggagatgcagccttctgtcccacaatgacaggaggtagcagtttcctgtaagggtaaggatcctactttgaccacccttaaaaaacaaaagcattttctatatgcccattatgtgttaagcactttacatgcattatctcatttaattctcataaaacctataaggtaagttctattattagactcattgaaattgaagtacagagagaccaagtgacttgcccaagtcactcagctggctagtcagtactaaaatggaaattttaacccaggcagattgattctggagcctattcttaggtagttacactgctttcctcaaggaccatgttccattgagaggcttaagttgggaagataaggtaaattattatgaaatatttatagaaaggacaaaagagagcaagagataacgcattccacctttgtctttagaatggtgtgattaagaaaacaaaaaaacctgggctgggctttatacattaagagaacattctaataaatgctactgccaccagaaaaaaaaaaaaaaaagaagagattattcttgcataaggagaggcaacaggaagtgtgaatgaggagcacaaatgtggaaagtaaagctgtttaaaaaggaaagcagctgcaaacttcccatctgcagtgtttgtttgtctcggctccggccatcactgccacgattacccctggatgaattcctcagtggaaatatcaacaaggtaggaaatgtgataattatattttctattgtcccccaaagaacatattaagatggtagatatggacataatttggaagaaaagtgctatgtagtagacacaattgctgatgaaataaaactagctgatttttcatcctctggtattagcaaaaaggcaaagtcccagatgttattctgtgcctcttctacagtgtagttgtaattgaacaacagctaggcttattggattgctttttgcctttctttataaaataaatatatattaagtatattctagacaatcttctagaggtcatagtagtaacagtgaatgatccaatagatggcttgggatatcacctcatactagttggtggggtatagaaagtattgatgcctgttgatgtaaaaaaggtttctggagggagctaacactcgagggggatttttttgtgactcaaaaatattgaatattgatatgtgatggaatattgatatgttaagctctctttctataacctccagcttttctgatgctgtcacctaagatgcctgctaaagcttgtactctcagcagtcttgcatggcaatctagaagtgtgggaatattaatgtcttgtagggaaaccttcaatcaaaaagaaccatgagacaatggtcaaacatttctctcttttgccccttgggcagccaattgtgagactttttgtatagctcctcataagatctgagtgaaatcacgcacaagttgcccacagtgatgttcaatgccctgtgcgcctttgcactgactttctctcctaccccattttattctcactagatcttctctcctatttcctggaatcatttcctaagtaaacgacctgaatgcaattcttatccaggttctatttttatggaggtcccagactaagacaatgccacatcataataggagcaacatctatgggctgagagatgagaggagtgtttgtcagggtatggtactggcatttaatatggctttctctcctctaccagatatctaaatattggcattgtggaaggtttctctaggatttatctgctcttttaaaatcttcttttctttatctacactttctcttctttatatttctcttctatattttctccttagacaatctacaattctgtggttttaaacaccacctttattttaatgattcccctggattatacctttagtccttatcttgcttcagagcaccagcatcatatatccaattgtctacatatcatctccctttggatgtctaactggcatctttttcttcatttgtacaaaataaaactcttgtttacctcccaatataataaacggtttcctacaaaagaagctgttatgcctctattctttttcatggcaccaccatctacactatagttcagacaaagaaaacctgatgttgttcttggttctaaccttttcacactcttcccagcaagttctgaatattatatctccagaagagatttaaaatttgtccacttatctacatccccactgccattgcccttgtcctaggcataattatcttttgtcaggaccactccaatagtcttataaaatctgttagagataataccatcagaatagtttaaacagatacacaaaagtcactagcccttttcaagcctttcaacggtttcctaaggcatctggaaataaaagttaaaaatctttccatgttcccaaggccctatatgatctaggccctgctaacattagattttttcttcttgtacactattgctatagactgagtgtttatgtgccccctagaatcacatgttaaaacctaactgccaatgtgatggtatttggaaatggggtctttgagaggtgatcagatcatggggcaaaggtttcataaatgggattagtgcccttataaaagaaactccagggagctagttagtcccttccatgtgaggacacagtgagactgctgtctatgagccaggaagtagtcctcaccagaaccaagttcactggtgctttgatcttgaactttccagcctccggatcagtgagaaatacatttctgttgtttataagtcacccagtctatggtattccattacagcagctggagtgaatgaagacatttatgcaccagctacagcagtatcttttcattctccaaaaagcccagcttctatctttcctcagggtcttccatttccaaaccttctacctggatagttccttttcctgcttttcatgggccatactccttattctttaggcctcagtacaaatatctcctcctctgagagtgattcttgtcttggtgacctgttaaaatgccctccatcccagttactgtctatcactacttgtttatttccttcataattcttctcagaaattttgtattgtgttttgagccatttttattttctttttatcttttcaattagaaggtaagctctgtaaggtcagaagtcttatctttcttgacaagttttacattgctaaactagatctggcaactttgtggaatataaatgaataggataattattttgagaaattcttccggatgggtgcatgtaggaatctttttttaaaaaaaaaaatttacactgaggcaaagaatctaataatgtcaatttttcctgtctcaataatctatacatccttgcatctttgaaaccctaatgagaccaggagagggaagtaaacaatcattttttgtgtatgtgtgaatacacaaagacattcttctaaatctttacttcttattttatatggtcagtattattttcaagtaggaagcaaaaccgatgattcatctcttagtaatcaaatttattataaccaattatattttttcaatagcttttatctaaatagaatgattacatctgaaaagcatgagatttttatgggaaaggacacaacttcaattctattcagtctataatgttttctctttttataaaaatgacttggctaacttcttgtaatataaccctgccacacacagaatgaaattcttagtacttcttaactcttcccctcttaagtcattctgtctttcagatacacacaaattcattgtctcaattcctttcaaagacccatgtatccgaaacttcaataccttttatttacaaatgcttcttttactctcgtttcagttttcatacctgccacatcaggatgtggtgcccagctttttcatgtcatcacaggctggatgtatttgcttcattttgtgattctggggcagagggccctgagttcactttggtagccttattctaaaatttggtgccaaatatcacaagtgtcaaaggaataaatgttttttatttttatggtgaaaataatgataaagcaagtccagtcctgtgttgattaactattaataccaatttttattatttctgaaaatatctacacacatttatgtatatcacagctaacattaaattcttaggcaatttttttcttaaaatcttatattagagcatcttgcagctttttgtaatttaggatttctcatactgaattttcctaaagagagacgcatgtctattgtttatgatttagtttcttgatatgtaataactgtatcatgggttttgtaaagcaactgggctgtaatgcatagatttgttaatattgtactctcggtttgccaaaatgacatgaaataatttgattttatatattgctcttgatgccccttgttactctcttatacctagctagactttgagattttacaatacatagattttctgtactctaacctcagggaaaactcattaccactttttcttttcttttcttttcttttcttttcttttttcttttttttttttttttttgagatggagtctctctctgctgcccaggctggagtgcagtggtgcaatttcggctcactgcaacctcaccctcctgggttcaagcgattctcgagcctcagcctcctgagtagctgggattataggcgcatgccaccatgcccggctaatttttgtatttttagtagagacggggtttcaccatgttggtcaggtgggtctcgaatttctgacctcgtgatccacccgcctcagcgtcccaaagtgctgggattacaggcgtgagccactgtacctagccaccacttttgttaattacttgatgggtatgagaagtacctgcttggtgatcagtctcactaatgggtcttgtctcaactaacttgaaaagaacccagaagaagatttgatgtatttgatcagtcaagtgctatccttgattcatctgagtgatttctatcctcttcacctctttctgtctgtgctccatgtttaataatcaaatgctcttaccatcagtgcagaggggtccagacctcccatatgggcagaggcagacaatatctgttccggattttggaacacaggtggcaccatttccacatgggttgttttcacaacttgcaaactggcacagcttgcctgaatacagccttggacactcacaaaacagattttcattatcactgagaagggaaaaaatttaaaaattcattaggaaacaactgatattttctacacacatacacatatatacacatgcatgaacacatatgcaaataaaattataattgcatcttttctaataagtgacttttttctccctcttttctgtttcaacttttgaatatttgtagctgtgtgctttccactgaaagcagattaatagctttatagattatctgaagccatgaattctattttaagccatctatttttatttttgatttgtctcatcttttatttcacactgggtgccttttcagggcttcattgaatatgtgtggtgctgccttaataaagtgcatcaaatgtctattagcaaaaaacatcttagactcaaagctcagaggagaattttaagctggtgataagcttccccactctgaggacaaagtcctccaagagctgcatttgtagtaattctgaaaataagacacagtggggagctataatgactatataactcttcagcttaaaatatggtttggtggccccaggctgtgagtgtgcatgaaagcagagctcaggaaaaatactcctcttacctgccagggaagcattctcaagagggagaagtgacttggagtttgttatttctgcctctctgcatccattgccccatttaaagtaacagatgccttcgttttcctttccaagacccacccctccaccattctcagcccatgttgtctgggagacacagtctccactcggtgccaatcatagtgtatagtgcagggtggatacatgacacgctaggccaactggccaacctctgctagaactctccagagagtactctttttatctgctggtgttgctacactggtaattgatggtggcgtgtgcctgtccagagggaagagcctagctgagaataaatagctaatacttagcaatgtaaatataagtgacagagaaatatagattattgattatctgggtaccagatctagccagtactctgtagttatgtgagacaatatattccactgcttttacatttttaaagccagtttgatttgggattttgtcacttgaagttaaagaattccatttaatcttttctttttttttttgctctcttattacattagttcatacaccttgccatatacagatcttaggagtttacatcttatcttctcaatgcgactgttagctcttaagcataggtgccaggatcagccctgataattgggaaactaacatatttttatgtttttatgacacagcctcccagtctagttgtagatcttacccataccatgaatttttccccagctatctgtatggtttctcaataccttcctcatgtctttgaatccccttactccaaaatttgtgtgtaggaaagaaccatttttttcatcataatgagacctgacttagaaatatgaaggtgtttccttttctaaaaatattcatattttaatattctccatgataatgttgtgaaacactatgaaagtttatgtatcagatagcagataaagctggctttggtggggttgtaaggctttgagaccttcagattttgccaactcataaggcttatcctgtaagtaatcagtaatttatgcattttataaccttcatggaaacctgcatagcattctacacattgcagacagatatggaatctcataagttttcagaattgggaaaaaattatatatcgatgcccctaagatggttataaagtatcctgagcaagattttctgtttccgagaaataaagttttgaggactgcttagctaatgctgttccttgtttcctgagaatagcgataaaagcacagccggaccacctagcaggtacagaaatatttctggtgtgacctaaagtatacgttagaaacttaatgttgtttgggggtaatggataaatctgatataactttgcttccactgaccttacttggagttgaaaggtcagtattaagcatttgtattctgggataaagtctaggaaagtagcattcttgagagctgccttctggaaggaccaaattagtctttttcagatcaaggagaatgcctcatatgtgaaagtcaaactaatctaagcattgattgatttaaatgctttaatcatataaagctaaacagatttggcatgcaggaaagatgattttatggtgaaaaccaaggaaagcactatttttaatcaggtcctattgataaatcaagccccatttcctctttctgctttcatcaggtgttgtcagaagttggttgtgtaaattcatgcggagacgactaactgtgtgcatctgtatgtcagcaggcaactagagtagagagagaactagaaattttatagaaaactctccaagaaaagggaagctcaccatatctaaccaagggcaagtgttcagagtcttctggcctgtcttgatatcccattagcacctcattagcaagagtcagctttactcaattgagatgttgccagatgatggcacttcaaattgtacctcaaagttccaaaagacttcttggagtgtcagacatttcaccagtagtttttgttttctaaatctatctttgctatcgtctgtgttatacctggactcaaaggtttctcctatccagatcttgtcagatcctgttattaaatcacaacttcttcaaaagctaccaagcctgctgttttctctgccacttgacctactttgatgtctctctacatcttgtagcaaaaggcagtgttgacccagaaagggaatgctctaagactgatggatcttatgtaagacagttgacttttggaaatagttttcaaaacagtgtcaccctcttttgctcagtttactttaaatattacattattgctgtgaattagtcactgcttattataattagctttgagagaatatatttatatgaaatatatttttttcatggaatatatcttttcatccctaaatttttaaaaattttatccttcacaagacctgtaaaccacatagaaacctttttttggaaattgtcctgtaagcaagtcaggagatttttctgaattaaaagtaggtctgcgaaataatccagattatggtgaagtttttacctatacaccagaggaccatatttattttggcaattgctgccatccaaagtttgttgtgcacctacatcatggatggatccatgtgccaagtggtgaataagactcgcttttgcattctttgtaggagacatcataaaggcacgaacaaatctctgtaagatacatagtatgtgacaaaggaatagagaaagtatcaagtattttaaggccttagctctgtaatatgtggattcagatgacagtagttactaaaagctggtctgtgaactggcaccaaaggattaccagggactctcctgaatgcgtttgctaaatgcagatttccatgctcctcttgccctctgagattctgatttagaatgtctaaagtaaggctcaagagtctgcctttaaaaaatgtcattaggagactcttttgcatagcctacttttacttaaacccatccctctgagacaaatattctctccagagtgaaagcttgatgggcattagttattattgtgtccttacaggatattataattttatttctgtttttgggctatgttttgacttttgaccaacatatatctgaaaacacatatatccgtcaaagtacaaagatgagaaggttttcattttaggagtgccatatacagtctactgcatgtgcattatgtttaacttcaacataaaagaggaaaaaattcactcggtcattttaaagcttagttaaaaaaataccacctatctaagcatatgccaacaactatatattttggaattgtaactgctacgggatatttgattacaagtctacaatacggtaagaatattaactgtcatttctatgagtattaaaagttacctttagaaaaatttagctgattaaaaaaaatcaaagaagctggcttgaaaagggtgcccactacttatataacacagctagatgccaaaaatcttctagaactaaaaggactcctgcatgtattaacttaaaaaaataaataactcttcttgcactctttgtatctaacagatcattagccgatttcaaagttggccacccacagtgtcaagagagggaggttctcagcaggaaagagtgcagaaatgaatccttatgaataatgtctccagatagttctgaaaaataaaattgctactggcggaaataacccatctctatgtatcggctctgatagcaccacagcccaggctttaggaggtatgcaaatgagatcccaagtagctgtggttcaagtagaactttccatctttttcatgaatttcacaacaccatgataagagcctgctaattacaaagaatacttcccctctcccctgcaagaatcttccttaaaaaattggaatttctgtcaaatgagttgttagctgtgtgtggagactctggctctagtactgtagatagatttttctttgtctgtttctaggacagaactgcctaaatggatgttattttgtgctgtaaggcacaccactacgtgtgtcatttttcatttataactttttaaaagtagccaagcatgaaaataatgggaaaaaaatgcaaaaccaaaattactttgtggtggcctagaaagtgaacttggagaaacatagtctatataatatacccatgaacagagagctcagggaaaatgtcctctgctatagaaacttttttctttatatgaaagggtttttctaaaggcaggaacaagataagaaagggtaagagcaaataaaagtcatagaatgacataggaataaataatacataaaatggaaaatccataaacaattaaaaacactttttttcttgttctagtatctgtccaatttaatcttgtaggcattttgcaaagaaaaatggaatatatggtataatctctcgccttctctcttccctcttccttctttctttctctctctgacaggcatggttcactttacaaaaaaataaacttcattggtaaagaaaaatgaccaaaatttcttccccagcaagtgcatcaggatctcctttccagaaagagatatcttttccatatctctggccttgtgaccctctagttcttatgaaatgaaattaaagttttgcttccaagggagcagacttggagaacatgaagcccaaaaggggagctaacatagtaaacatggccattatctaaatacattaaatgaggtatgtgtgagaatgtgcccagcacagtacttggcattgatcagctgctcattatatattaggaaaaggaggtaagaataaatgaaacatgtaattagttgtgtctgaatcagttaatggtggaataagacaaatatgatgaaatctggtacaaagagaagtgggttgggaaagaaggataaggtgtagggtattgtgggtgaaaaaataaaataatgcattaataattgtttgtcaaatgaatgtatcatttcagtgtctagaattaccctccccccataaaaaaaatctcaggatcttagaattatactctgtgcccaaactacaatttcataataaatttttctcactctgtgctcactgtaaaattagccagtctccagccccctgcatggtaagggcaatctgggcaggattcaatataacagaatctgtaaatgcagtgcttatgaagctctggagctctcaggtaatttcctgtaaagataatgtgcctattttgaagctatttaaggctagaagagttggtatgagcttttaaaatgttattttaatttccactaaaaagacataaaaaattatcttaaaatatttaagccagcaaagtgccatttcacccattcccctgacctcagtaatgttcacatacacacagtttctactcaactgttaccatggtgaattcaccagttatcaggaaggtagaaacacagcacacaacgtcgatggttgttcttttctgatattaagaattatttacaaaattgctgtgggtggaaaatttattccttaaaaatgaatagtagataacaactctctagaaaggtatacatttatgaacccaaagtatcctttatgggtattcctatgttgaatttgcaatgagaatttaattttttttgcagtttctcacttattccacagcctttcttttgtcaaatctttacactccaattttgagttggaaaaaaagcaagaaatttagaggtgttcttgcttctaaatatgttgatttggcaggcttgctctaaaagtagtttgtgtctgccacttagagcaagcaggtgacttttggaattgtcccaaatctctttatatagagtcagtgtactgagcaatgtaaaccagagattactaactggcaagatgtttaatgcctacctcttgaaccccgtggtatatttagattataatctgaagcctagagatgaagttaggtgcacagttgtaagggacaatataaaattcaccacttcatcaaaattcatcaaatttgattaaatatcaaattctccttctacccaatcgttgttcagatctttcccagtcctgtgatctctgctcagaggaagtgacttcacttcctactctatagataaaattttagccttcagcacctctcttgacttccacattatctcttccagcacttattctccatccttttttcctcttaccccaattcccaataacaagtatttctttccaatgctagaatttcacttaatttaatcctatcaatatatttgaagcatagagtataagtagatctgagctgagatgcaagaagcggccttggtccttttaagaattttcactttaacttattggcaatagacattgaaacgtttttgatgagggaatgaattatattatgttttagaattattattctggggaaaatgtctggagaacagtaaacccagggacagagttttccccgttattaatttatcatctgctgggcgtggtgactcatgcctataatctcagcattttgggaggctgaggtgggcagatcacttgaggtcaggagttcaatcccatcctggccaacatggtgaaaccccatctctactaaaaatacaaacaattagctgggtgtggtggcacatgcctgtaattccagctactcaggaggctgaggtgggagaatcactggaacccaggaggtggaggtttcagtgagccgagatcatgccactgcactccagcctgggcaacagagtgagactccatctcaaaaagaaagaaaaaaaaagaatgtgttgtttgttagttccaaatctaccctttataatccttccttgtgatgctggagctggaccctgtaaacacattccctttgccaactggggggatgttaagctttgtcagtagagggcacttgggacactgaaggaagaagaggttctcttcctagctctgccgttctttcctgtcttcttactcctgctggaggcacgcgcaggaaactcagtgctgctcacccccagcaagttccacagcacctcccctggagaattaccaccaggagacagcccatgacccacccaactttccagcttctaggtgtcccagtgggcaaattcttagcaagttcagcagcaccttcaagtgtggctttctagtaagttttcctggaccttatagtgagtggcttgaaacagtttcatagacgccccagtgggcaggaattctagcaagttcagcagcatctttgtggtggcttctcagtgagctccctagagtcccagagggtagcttcccagtgcatttcagcagcgccccattatatggcttcttctttcccagtcttggactggggtatcacagtgaacttttctgtcactcaatggccacactctccatcgtgctctgcataccaggtggtgtgtgtgtgtgtgtgcacaagtgtgtaggtatgtgtgtgtaagtgtgcatgtgtgtgtgtatgtgtgtgagtgtatatgtgtgtcttctgatttgttccttggagcactgtttctcagccctagaggtaggaatggctcctacatccactatacctaaatatggtttttttttttttttttttagacctagtctcgctcttgtcacccaggctggagtgcagtggtgtgaattcggttcactgcagcctccaccttctgggttcaagcaattctcctacttcagcctctcaagtagctgggattacaggcacatgccgccatgcctggctaatttttgtatttttagtagggatgatgttttgccatgttggccaggatggtctcaactcctgacctcaggtgatctgcctgccttggcctcccaaagtgctgggattacaggcgtgagccaccatgcctggcccacctaaaatatttaatgtactctttgcatcttaaaaattaatcccatgttactggataataaatcttcatattaaactttcctaaattactgtgtggctctgtctcttgaccaaaccctgagttatacacagaaatccaagcagaagtgtagataagcttagtggaagtgggcatggagagaaataatttgagagatgctcagggagaaaaatatctttttttgttttttatttttttattatactttaaattctagggtacatgtgcacacgtgaaggtttgttacatatgtatgcatgtgccatgttggtgtgctgcacccattaactcgacatttacattaggtatatctcctaatgctatccctcccccctccctacaccccatgacaggacacggtgtgtgatgttgcccacactgtgtccaagtgttcttattgtttaattcccacctatgagtgagaacatgagatgcttggttttctgttcttgtgatagtttgctgagaatgatgatttccagcttcatccatgtccctacaaaggacatgaactcatccttttttatggctgcatagtattccatggtatatatgtgacacattttcttaatccagtctatcattgatggacatttgggttggttccaagtctttgctattgtgaatagtgctgaaataaacatacatgtgcatgtgtctttatagtagcgtgatttatattcctttggatatatgcccagtaatgggatcgttgggtcaaatgggatttctagttctagatccttgaggaatcccccacactgtcttccacaatggttgaactagtttacagtcccaccaacagtgtaaaagtattcctatttctccacatcctctccagcacctgttgtttcctgactttttaatgattgccattctaactggtatgagatggtatctcatggtggttttgatttgcatttctctgatggccagtgatgatgagcatttttttcatgtgcataaatgtcttcttttgagaagtgtctgttcatatcctttgctcactttttgatgggttttttttattttttcttgtaaatttgtttaagttctttgtagattctggatattagccctttgtcatttgggtagattgtaaaattttcctcccattctgtagggtgcctgttcactctgatggtagtttcttttgctgtgcagaagctctttagtttaattagatcccatttgtcaattttggcttatgttgccattgcttttgatgttttagtcatgaagtccttgcccatgcctatgtcctgaatggtattgcctaggttttcttctacagtttttatggttttaggcctaacatttaagtctttaatccattttgaattaatttttgtataaggtgtaaggaaggaatccaatttcagctttctacatatggctagccagttttccgagcaccatttgttaaatagggaatcctttccccatttcttgtttttgccagatttgtcaaagatcagatggttgtagatgcgtgctattatttctgagggctctgttctgttccattggtctatatctctgttttggtaccagtaccatgctgtttttgttaccatagccttgtagtaccgtttgaagtcaggtagcatgatgccaacagctttgttcttttggcttaggattgtcttggcaatgtgggctcttttttggttccatataaactttaaagtagtttttttccaattctgtgaagaaagtcattggtagtttgatggggatgtcattgaatctatagattaccttgggcagtatggccattttcccgatattgattcttcctatccatgagcatggaatgttcttccattgagcagtggtttgtagttctccttgaagaggtccttcacatcctttgtaagttggattccgagatattttattctctttgaagcaattgtgaatgggagttcactcatgatttggctctctgtttgtctgttattggtatataggaatgcctgtgatttttggacatcgattttgtatcctgagactttactgaagttgcttatcagcctaaggagattgtgggctgagatgatggagttttctaaatatacaatcatgtcatctgcaaacggggacaatttgacttcctcttttcctaattgaatactctttatttctttctcctgcctaattgccctggccagaacttccaacactatgttgaataggagtgatgagagagggcatccctgtcttgtgccagttttcaaagggaatgcttccagtttttgcccattcagtatgatattggctgtgggtttgtcataaatagctcttattattttgagatatgtcccatcaatacctagtttattgagagtttttagcatgaagacctgctgaattttgtcaaagcccttttctgcatctattgagataatcatgtggtttttgtctttggttctgtttatatgatggattccatttattgatttgcttatgttgaaccaggcttgcatcccagggatgaagccaacttgatcatggttgataagctttttgatgtgctgctggatttggtatgccagtattttattgaggatttttgcattgatgttcatcagggacattggtctaaaattctctttttttgttgtgtctcggccaggcatggtatcaggataatgttggcctcacaaaatgagttatggaggagtccctctttttctattgattggagtaatttccgaaggaatggtaccagctcctccttgtacctctggtagaattccgttgtgattccgtctggtcctggacttttttgggttggtaggctgttaattattgcctcaatttcagaacctgttattggtctattcagggattcaacttcttcctggtttagtcttgggagggtgtatgtgtcaaggaatttatccatttcttctagattttctagtttatttgcatagatgtgtttatagtattctctgatggtagtgtgtatttccatgggatcggtggtgatatcccctttatcattttttattgtgtctatttgattcttctctcttttcttctttgttagtcttgctagcggtctatcaattttgttgatcttttcaaaaaaccagctcctggattcgttgattttttgaggagttttttgtgtctctatctccttcagttctgctctgatcttagttatttcttgccttctgctagcttttgaatatgtttgctcttgcttctctagttcttttaattgtgttgttagggtgtcaattttagatctttcctgctttctcttgtgggcatttggtgctataaatttccctctacatactgctttaaatgtgtcccagagattctggtttgttgtgtctttgttctcattggtttcaaagaacatctttatttctgccttcatttcgttatgtacccagtagtcattcaggagcaggttgttcagtttccatgtagttgagcggttttgactgagttttttaatcctgtgttctggtttgattgcactgtggtctgagagacagtttgtaataatttctgttcttttacatttgctgaggagtgctttacttccaactatgtggtcagttttggaataagtgcgatgtggtgctgagaagaatgtacattctgttgatttggggttgagagttctgtaaatgtctattaggtcctcttggtgcagagctgagttcaattcctggatatccttgttaactttctgtgtcatggatctgtctaatattgacagtggggtgttaaagtctcccattattatggtgtgggagtctaagtctctttaggtgtctaagggcttgctttatgaatctgggtgctcctgtattgggtgcatatattaggatagttagcttttcctgttgaattgatccctttaacattatataatggccttctttgtctcttttgatctttgttgatttaaagtcttgtttatcagagactagaattgcaacccctgctttttttttgttttccatttgcttggtagatcttccttcatcccattattttgagcctatgtgtgtctctgcatgtgagatgggtctcctgaatacagcacactggtgggtcttgactctttatccaatttgctagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgattttgcagcggctggtactggttgttcctttccatgtttagtgcttccttcaggagctcttttagggcaggcctggtggtgacaaaaatctctcagcatttgcttgtctgtaaagtattttatttctccttcacttatgaagcttagtttggctggatatgaaattctgggttgaacattcttttccttaagaatgttgaatattggcccccactctcttctggcttgtagagtttctgctgagtgatctgctgttattctgatgggcttccctttgtaggtaacctgacctttctctctggccgcccttaatgtttttttccttcatttcaactttggtgaatctgacaattacgtgtcttggagttgcacttctcaaggagtttctttgtggcgttctctgtatttcctgaatttgactgttgggctgccttgctaggttggggaagttctcctggataatatcctgagagtgttttccaacttggttccattcttcccaacactttcaggtacaccaatcagacgtagatttgttttttttacatagccccatatttcttggaggctttgttcatttctttttactcttttttcttaaacttctcttcttgcttcatttcattcatttgatcttcagtcgctgttaccctttcttccacttgatcaaatcggctactgaagcttgtgcatgcatcacgtagttcttgtgccatggttttcagctccatcaggtcaattaaggtcttctctacactgtttattctagttagccattcatctaacctttttgaaggtttttagcttctttgcaatgggttcgaacatcctcctttagctcagagaagtttgttattaccgatcatctgaagccttcttctctcaactcgtcaaaataattctccatccagctttgttctattgctggtgaggagctgtgttcctttggaggagaagaggcactctgacttttagaattttcagcttttctgctctggtttctccctatctttgtggttttatctacctttggtctttgatgatggtgatgtacagatggggttttggtgtggatgtcctttctgtttgttagttttccttctaacagtcaggaccctcagctgcaggtctgttggagtttcctggaggtccactccagaccctgttttcctgggtatcaccagtggaggctgcagaacagcaaatattgtagaacggcagatgttgctgcctgatccttggtctggaagcttcgtttcagaggggcacctggctgtatgaggtgtcagtcggcccttactgggaggtgtcttccagttaggctactcgggggtccgggacccacttgaggaggcagtctatccattctcagatctcaaactccatgctcggagaaccactactctcttcaaagctgtcagatagggacgtttaagtctgtagaagtttctgctgccttttgttcagctatgccctgcccgcagaggcagagtctacagaagcaggcaggcctccttgaactgcggtgggctccacccacttcgagcttcctggctgctttgtttacctactcaagcctccgccatggcagacgcccctcccccacccttgctgtcacctcgtagttcaatctcagactgctgtgctagcagtgtgtgaggctctatgggtgtgggaccctctgagccaggcacgggatataatctcctggtgtgccatttgctaagaccattggaaaagtgcagtattagggtgggagtgtcccgattttccaggtactgtctgtcatggcctcccttggctaggaaagggaattccccgactccttatgcttcctgggtgagacgatgccctgccctgctccatgggctgtacccagtgtgcaacaagccctggtgagatgaacccggtacttcaggtgcaactgcagaaatcacctgtcttctatgtcattcacgttgggagctgtagactggagctgttcctatttgtccatctgggaacctccccctatttcagggagaaaaatatctaacttgatgattggtttctggtttgtctagctgagtagattttggtgccattcttgaaactgaagaatatataaatttagaaagtcgagggagaatataatgagttcatttataggcatatattatttgatgtatccatggacatgctagtaactattttcagtagtgtaggaataagttatcaatataacttattttaaaaataacataaacataattaggcttttattataattaagaaaacctctggattacaatgctggttggtggagagagggagaggctactgaagaaaaataaactttgactcaaataccttacaaattcaaagtactagagcagctacttacatatcaacaaaacagtaaagtttgcactaaaagcttttatccattgtacttatctaaatagaaagatccccatgtgtatggggacatggtgtggcagaatcctttttaggcttaaatgcatatatactctttctcttataaatgcaattaccacgcatgaaatagctatgaaatatctgttcatcctggggacagtttggttagcttcttgggaatagttgtgaagatgaaaactatgtccatgaaggaaagctgactgagtagaaagtatttcagctcgtttccatacaactgttgttattgttgatgatgatgatgatgattcattataaaatgaagcatctggggtgactgcctaactggacaggatgccaggataacaggggtaaacagggactatcccagctaaaccaggggtgtggtcaccttctatttgaagtcataacattttttccttaggttattgttgtactgaacgtattaaatatagagtttccatcttaaactaattctgaagtagagatgctgtgattttattttaactgttgtattatctggaaactcattctactggggctcaaatttacatatatttagggcatgagcatggtgacggttaatactgagggtcaacttgattggattgaaggatgcaaggtattaatcctgcatgtgtctgtgagggtgttgccaaaggacattaacatttgagtcagtgggctgggggagacagacccacccttaatctggtgggcaccatctaatcagctgcaagcgaatataaatcaggcagcaaaaatggcctagtcttccagcctacatttttctcctgtgcttggatgcttcctgccctcaaacatcggactccaagttcttcagttttaagacttggactgcctctccttgctcctcaagcttgcagacagcctattgtgggaccttgtgatcatgtaagttaaaacttaacaaacttcccattatatctctgtctatctgtctgtctgtctgtctgtctgtatctatctatctatctatctatctatctatctatctatctattctgtccctttatggaaacctgactaattcaggcttggaccaatattttgtgttaagttgttgagactgagacacaaagatcagataactgaaaacagttttcctgaagaaggaactactgataataaatcactgctttgctgcctttgaaataatgtgcttcctcctaccccctttctctttctttttcttttttaatcctgaaaggggtaatttcagttttaaatacaagaggctgaaagtggcttcaggctttttcaattaaaagatttagtttgcaacttctttgcactggaaaagactaaatctcttggaatcagttgacatgatgttaaaatggactgtgctatttctttaaaagccatgtacaatggccatttctcatcaaaaggtgttttggctgtaggcaagcttcttagttccataaccttatggatggtaaaggacagtttcaaaaggcatttatacctagttaacactttttttttttgacacactattagatgtgacaattttcttttacaataaatggataaaagaataaaaggaacaaccaactttccctgctgtttcaatagtttcaattagtttatttcccctcaattgctccttcagatgggctagataagatttcactatttggggggatcgttttaagcttcttttccagcagtttgttatttttaaagctccagtgattcactataaaatgcatctccatctgcaggaagcaattcctaaattgcttcactcaacaaatccaaaactgctaggctcactatagcacagaaatagaactgatttggaaagggattacctattgggttcagaaaaacctcttctgagagaggttatggcatggagcagatctctgaatgccagagggaacttttattttattgtatttagcaagaatcgtttgaagttttgtttattggtctgaactatttcctggtaaaaatatactttggtaactaatatatataaattatgagttattgcaaactccagttccgaattaaaattttctaagcaacttaaaattatgtctgaatatacatacttaaatacgtttttttccagaacttactaaatcttaagttgaatttatttcacttaaggttaatccttttccccacctccccttggcacaaatatgcaaaatattaacctttagcctgaaaatgttatttccattacttatagaatagggtcaaatatttggcatatattttatctacattaaagtgtaacatgggttagaaaatcttggtttatattagttgttttcaatctaattaaagtaaaatagaaacaagaaaaaaatgcaggtcaagcgacaaggaattgtttgctagtttaatcacatataggaagctattgttatccttgagacttagacaagttgactattctataggatttttaaagacaggacatgatttatcttaatactgtgtcagcattttcctgaaactgatttagccttttgcattaaaaagaagagacacactagaacttttaattgaaaaaacctgcagctactttcaacctctaatatctaaaatcaagttatctctttctgaaaagaacaaaaaggaagtagctaatcttgaagttgttcaggagtcatttattaccaaaagtatttttactgactgtcccaattcctttaggaaacttcaagctatgaagagcataatatataaaacagactatttaagggatactttgtcttattacaaaagttgtcactcaagtctccaataaatagcttcatacaaattttttttcagggatacaccatttgccacaggcaaaactgtcacatcgcatttggttttacactggagttccttgatgttgttccataagcctccatgaggggcagaggagcaggccttccatccactctgccatgcctcgaccagagttagtttgctttatttattcattcattcattcacccactcaacgtttactgaactttttccctattccaggcactgctaggcactgtacaactgtgttgaatgaaatagatatcatcccgttttgcattgagtttgcaatctagatggtgagacaagaattaagtaactaaatagaaaatgacacattatattaagtcctaaaagagaatatcacattggtgctatgggagagcacagcaggcggcctattttagataaatggttgggggagagttttcagtggaattaataattaatccgaaacataaaaaatgcaaaattgggtaaggtgaggaataggaaatgtttaaatagtgaacaacagatatgaatgctaagatatgagagaaagtctgacatagttcaggactggaaagtagccacttttgcccagagttcagcaaaaaggagatttgaaaaactatacagaggctagatcatgtaggatgtctttgataacaaaatgtactcaacatgtaacttaaccataattagtgtgattttactccccagcagctgaaggcaatactctacaaaaaattccaaatatatattataacatagtattcacctttgttcaaagaattgattcagcccataatcagtcacaacacctcctagcatttagagcaatggcttcctttacatatggaaccaaattttggaagccgaagttggaactttcttactaaggcctccagggctggatatgatctggcccctgttccactctgtgactggactctttccactctctcactgtgctcttgcttcacatgtccttggtgtgccatgccacatcaccacggctccaactgacttttaatgtaactatgctgacagttccctgggaactcagactcactgcactctgacaacttctcaccataaacagcaaaccatttcttctacccttgtgaaaacacagtctgaaggagcagagtcaatgccccacgggggaaactctcaaccaacgtggctggaagtcagcagataattgcttctgcctttaggtgaacacttcttgcagataatctgtaggctactcaggatgtcccagcagaatagaatcctcgaagtagggactctacaactctgcttaatgccggcttttccctctgccctgtcttcctgtcccgagtctttcccttgctccttgggactgcctccaataaattgcttgtaactaaacctgtggtataacctctgcttttgggggaattcgaagctatggttctggtctttttaatttgcatacagtctgtgtttgctccccatttagttcctttgtgcttggcctagaaccttctttctcttttgtatgatactctcatggctgacgccttctcatcattcagtttcagcctcaatgttatttcctgagaagagcctttcctctaatccagtgttgttctcaactgcttgtcactacttcattacgtaactcttagtatgtttattataactgatcacttttgagatgtgcgtattttcttattaacttattttattacacatttacttgtattgtacctagaattataagctccaggagagcacaacccttactatgctgtgaaggattgtgctcacaaagtctagaacaatggctgtcatataatggtcatgcagtaaatatgagttgaaggaattaacaaatgaaattcaatgtgttttcaaggtgggataatagaatatagaataatgcttttcttttaagagcatgcatttgaaacagtctcttatagtgtttccattactaagaagatacatctgaagcttccatcaagtaagtaaaaagaataaaaaaaaaaattcaaattttagatgcagctgtcctttactggtaacttttcacttatttttagttttactaaaatgtcctaactggatagtaattacccttgtgagagagggtatgtactatcaggggacataagagagcctcctggggtgctgaaaaatgttacctagcttgatttgggttgtggttacatggttttgtacatatgtaagaattcattgagatttgtgtgctttactgtatgtatgttatcttttattttaaaaatcttgaccaagttcgtgcatggggagcaaaaatacgcaccaattttgtaagttttaaaaatataaagacctctttagtgtcaaatttatttttcagatagtccgtcaaatcctgattttcgaaatcttagtttggttgttaaggaataccttgatcatatttttacattgaagttatcaaatactttatattaacatagggaaaaatcaatctatactatgtaaattcttggagaggcggaatctttcttcttcaatacacttttttttttgaaaatgtacctttttttagtgaaaattgtgtatcaattggaaacactttatcagctgtcgtagaaataatacgctatcttaatcttctttgcattggtcctgtgaagaaattttataatgggtaggtggagtgtttccatttttattaaatttgtatttgcttgttctttccatttgcatctcatgctaaattacatggcaaaattaacaccaactgaagtgcaggttctaaatggaaatctattatatcctcccatattttaatcaggacttatgtgttttataaatggcaattaagcttttcatggagtgcactggtaatgctcatataacatgaagcaccaaacatataggagtaatctcatagcattagggtagatcccaattactggccaagtaggctacatcttttgtcatctgggttgagatgctggatgttctccattctgaaagtatctgctcattgtcccatagctgctccatgaaaatccatttttggtgtttgcttcattttaggaagagaactaaacattcttctcataatttaaggactcttccagtgccaacatgtcaatgatactcatggccaatgagtatctcaatgatactctttttctttgatgcaatgatttcattcacttattgattcaggcattcaataaatatttatgaagttctgatgtgttaggcacaggtttgctaaggtagaaagacacataaggtgtgaccatatctgatcaagattttagtctaaattagtagttcttaaagttagttttgcatctgaattactagtcagaaatacagatctatagttctcaccaaggagctacttactagaagcagaatctgggggcatgggaactgagtgagttcctagattagagatacacagctttgatggccagatttttagctctccataatattccctttgcaagaacttgacccaattcgggactaaaaagaaaatctttatattgatctgagtctcccaactgttgtagatgtaatcattggctagacttgtactcttttgagcaatattcttcttccaatgtgaatggcatgtagttaatatcaaataagtatttgttgaacaataaacgactgactgacagtctttcaaccattcaaactcagctgtcttcaggctaatcatttcttatggtatggcttcaagacctatataggaacttgaatgttggcatctgagatttcctggtagttagggtaagaatgggaacttgatgctcaatgcttttaatcatgctttgattttacaatgtctaaataatttgtaaattttatgttgagcaaaaggaaatagccctttatctactggcttgggccatacaaggatcatcttaaatctatttatctattttatttcaaggaacattgaatattcttttgagtacattttacagggttaaaagttgatatattttaagtttgtattttaagatatattgtctacagaacaaggcctatggtcagttttctaggttagataacataaaaatgaagttataattggaagtcccatagtttgtacagactaaacaaaaggaaaaagttgtatatgtgtggctgcattccaaaaaaaagtgatgttattactttagatcattttgttaaacgtttggaacatttcaagaagtaatgctatgcaagtttcaacatagcacattctcaaaatgaaaaacacttcagggaatttggtaataaggtgataacaagatgatgaggtgctaaagaagttagtttctgctttgaattttttttagtccattatccttattgatgtcttataacacttcgatctatatactgaccttttattctgactgctaccttcactgtgcctatcacacatttttgggagatggcgatatattatgaaaagttgaaagtgcccccaaaagcattaaatcaaatgctataaaattgagtgctgacatttttcaaaagtgcaaaaagtacaatagtgagagtttcagagtgtcgaatattaccatggaaggaaactggccctgggagaattaaatctgagtatagaaaatgaggcaactttaatatttgacacaaaaggttgttttcttactttttgctaatggaatataattaagcattaattgctcttattctcctttgaatcagacattcaaagggcaggtaggtcaggatactgtctggctcatttattagaaaagcatgcaaacagttgacctagaaacacattgacagaacaagggcctactagtgggacagcatctgcaggcataagcaccagttagatattaatataagctccaaatatgtaagtacactacttttctccagggacatgctacagtttcacttctttatgttgagcatggaatataatgagaatatatccagaccattaagtgactaaaactgagaaaggccttaactaaaagaggaaagaggaataaaaggtgttttttttttttttttttgtctttgaaaatagaatggagggattcccaggcaagatagccaaataggaaaagctccagtctgcagctcccactgagaccaaagcagaaggccagtgatttctgcatttccaactgaggtaaccagttcatctcgttgggactggttagacaatgggtacagcccacagagggtgggcagaatcagggaggggtgtcccctcatccaggaagcacaaggggtcggggaactccatcccctagccaagggaagccctgagggactgtgccataagggacagtgcactctggcccaaatactacacttttcccatggtctttgcaacctgcagactgggagattccctcgggtgcccacgtcaccagggccctaggtttcaagcacaaaactgggcagccgtttgggcagccactgagctagatgcagaagttttttttcataccccagtggtacctggaaccccagtgagacagaaccattcactcccctggaaagggggctgaagccagggagccaagtggtcttgctcagcagatctcacccccatggagcccagcactggcttgaaattcttgctgccatcacagcagtctgaagttgacctcggatgctagagcttggtggggggaggggcatttgccattactgaagcttgagttttcccctcacagtgtaaacaaagcttcctggaagttcaaactgggtggaacccactgcagtgcctcaaagaaactgtagtcagactgcctctctagatactgcctctctgggaagggcatctctgaaagaaaggcagcagccccagtcaggagcttatagacaaaactcccatctccctgggacagagcactgggggaaggggcagctgtgggcgcagcttcagcagacttatacattcctgcctgccagctctgaagagagtagcagatctcccagcacagtgctcaagctctgctaagggacagactgcctcctcaaatgggtccttgacccctgtgcctcctgaaggggagacacctcccagcaggggttgacacacacctcatacaggagagctctgtctggcatctggcaggtgcccctctggggcgaagcttccagaggaaggatcaggcagcaatctttgctgttctgcagcctccattggcgatacccagggaaacaaggtctggagtggacccccagcaaactccagcagacctgctgaagagaggtcagactggtagaaggaaaactaacaaacagaaagcaacagcatcaagatcaacaaaaaggatgaccatgcaaaaactccatccaaaggtcatcaacagcaaagaccaaaggtgataaatccatgaagatgtggtaaaccagcgtaaaaaggctaaaaattccaaaaaccagaatgcctcttctcccccaaaggatcacaacttcgtgtaagcaagggcacaaaactggatggagaatgagtttgacggattgacagaagtaggcttcagaaggtgggtaataacaaactcctctgagctaaaggagcatgttctaatccaatgaaagaaagctaagaaccttgataaaaggttagagaaatttcaaactagggtaaccagtttagagaagaacataaatgacctgatggagctgaaaaacatagcacgtaaacttcatgaagcatacacaagtatgaatagccgaattgatcaagtggaagaaaggatatcagagattgaagatcagtttaatgagataaagtgtgaagaaaagattagagaaaaaagaatggaaaggaataaacaaggcctccaagaaatatgggactatgtgaaaagaccaaacctacattgattggtgtacctgaaagttatggggagaagggaaccaagttggaaaacacacttcagaatattatccagaacttccccaacctagcaagacaggccaacattcaaattcaggaaatacagagaacaccacaaagaagagcaaccccaagacacataatcgtcagattcaccaaggtagaaataagggaaaagatgttaaggggagccagagagaaaggtcggggaagccacaaaggagagcccattagactaacagctgatctctgcagaaaccctagaaaccagaagagtgggtgtcaatattcaacattcttaaagaaaagaattttcaacctagaatttcatatccagccaaactatgcttcataagtgaaggagaaataaaatcctttacagacaagcaaatgctgaaggattttgtcaccactaggcctgccttacaagagctcctgaagaaagcattaaatatagaaaggaaaaactggtacgagccacagcagaaacaaaccaaaatgtaaagaccatcaacactatgaagaaactgcatcaactaatgggcaaaataactagctagcatcatagtgacaggatcaaattaatacataacaatattaaccttaactgaaaatgggctaaatgccccaattaaaaggcacagacttgcaaattggattaagagtcaagacttctcagtctgctgtattcaggagacccatctcacgtacaaagtcacacataggctcaaaataaaaggatggaggaagatttaccaagcagatgaaaaaaaaagcaggggttacaatcctagtctctgataaaacagactttaaaccaacaaagatcaaaaaagacaaagggcattacataatggtaaaggaaacaatgaaacaagaagagctaactatcctaaatatatatgcacccaatacaggagcacccagattcataaagcaagttcctagagacctacaaagatacttagtttcccacacaataatagcccactgtcaatattagacagatcaatgagacagaaaattaacaaggatattcagaacgtgaactcagctctggaacaagcggacctaacagatatctacagaactctccaccctaaatcaacacaatatacattcttctcagcaccacatagcacttattctaaaattgaccacataattggaagtaaaatactcctcagtaaatgcaaaagaatggaaataataacaaacagtctttcagaccacagtgcaatcaaattagaactcaggattaagaaattcactcaaaaccacacaaccacatggaaactgaacaacctcctgaatgactactgggtaaataacaaaattaaggcagaaataaataagttatttgaaaccaatgagaataaagacacactgtaccagaatctctgggacacagctaaagaagtgtttagagggaaatttatagcactaaatgcccacaggagaaagcaggaaggatctaaaatcgacaccctaacatcagaattaaaagaactagagaagcaagagcaaatatattcaaaagctagcagaagacaagaaataactaagatcagagcagaacttgaaggagatacagcatgaaaaacccttcaaaacatcaatgaatccaggagctggttttttgaaaacattaacaaaatagaacacaagccagactaagaacaagagagagaagaatcaaatagacacaataaaaagtgatagaggggaaatcaccactgatcccacagaaatacaaactaccatcagagaatactataaatacctctgcacaaataaactagaaaatctagaaggaatggataaattcctggacacatacagcctcccaagactaaaccaggaagaagtcaaatccctgaatagaccaataacaagttctgaaactgaggcagtaattaatagcctactgacaaaaaagtacccaggaccagacaaattcacggccgaattctaccagaggtacaaagaggagctggtaccatcttcttaacctattctaaacaatagaagaagagggtttccaccctaactcattttatgaggccagcatcatcctgatacctaagcctggcagagacacagcaaaaaaagatcatttcaggccaatatccctgatgaacatcgatgcaaaaatcctccataaaatactagcaaactaaatccagcagcacattaaaaagcttatccacgaccatcaagtcagcttcatccctgggaggcaaggctggttcaacatacgcaaatcaataaacataatccatcacataaacagaaccaatgaaaaaaaccacatgattatctcaatagatgcagaaaaggccttcattaaaattcaacaccccttcatgctaaaaacactcaataaactaggtattgatggaacatatctcaaaataataagagctatttatgacaaacccatggccaatcatactgaatgggcaaaagctggtagcattccctttgaaaaccggcacaagacaaggatgctctctttcaccattccatttctacatactattggaagttctggccaggggaatcaggcaagagaacgaaataaagggtattcaaataggaagagagaattcaaattgcctgtttgagatgacatgattgtatatttagaaaaccccattgtctcagcccaaaatctccttaagctgataagcaacttcagcaaaatctcaggatacaaaatcaatgtgtaaaaatcacaagcattcctatacaccaataatagacaaacagagccaaactatgagcaaactcacatttacaattggtacaaacagagtaaaattcctatcaatacaacttacaagggatgtgaaggacttcttcaaggagaactacaaaccactgctcaaggaaataagagaggacgcaaacaaatggaaaaacattccatgctcatgcacgggaataatcaatattgtgaaaatggccatactgcccaaattaatttataaatttgatgctattcccatcaagctaccattgactttcttcacagaattagaaaaacctactttaaatttcatatggaaccaaaaaagagcccatatagacaagacaatcctaagccaaaagaacaaagctggaggcatcacactacctgacttcaaattaatctacaaggctacagtaaccaaaacagcatggtactggtaccaaaacacatacatagaccaatggaacagaacagaggcctcagaaataccaccacacatctacaaccatctgatctttgacaaacctgccaaaaacaagcaatggggaaaggattccttatttaataaatggtgttgggaaaactggctagtcatatgcagaaaactgaaactggaccccttccttaaatcttatacaaaaatcaactcaaaatgaattaaacatttaaacataagacctaaaaccatgaaaaccctagaagaaaacctcggcaataccattcaggacataggcatgggcaaagacttcatgactgaaacaccaaaagcaattgtaacaaaagccaaaatggacaaatggggtctaattaaactaaagagcttctgtacagcaaaagaaactatcgtcagagtgaacaggcagcctacagaatgagagaaaaattttgcaatctgtccatctgacaaagggctaatatcctgaatccataaggaacttaaacaaatttacaagaaaaaaaccaacaaccccatccaaaagtaggcaaaggatatgaagagatacttttcaaaagaagacgtttatgcagccaacaagcatatgaaaaaaagctcatcactggtcattaaagaaatacaaatcaaaaccacaatgagataccaccttacaccagttagaatgatgatcattaaaaagtcaggaaacaacagatattggagaggatgtggagaaataggacacttttacactgttggtgggagggtaaattagtttagccttgtggaagacactgtggcgattcctcaaggatctagaactagaaatgccatttgacccagcaatcctaatactgggtatatacccaaaggattgtaaatcattttactataaagacacatgcacacatatgttgcttgcttcactgatcacaatagcaaagacttggaaccaacccaaatgcccacaaatgttagattggataaagaaaatgtggtacatatacaccatggaatactatgcagccataaaaaaaggatgagttcttgtcctgtgcagggacaaggatgagtctggaaaccatcattcttagcaaactaacacaggaacagaaaaccaaacccgcatgttctcactcgtgagtgggagttgaacaatgaggacatatgagcacagggaggggaacatcatgcaccagggcctgttggtggttggggggcaaggggagggatagcattaaggaaaatacctaatgtagatgacggactgatgggtgcagcaaaccaccatggcacatgtatacctatataacttgcatgttctgcacatgtatcccagaacttaaagtccaataataataatagtaataaaaacagtgaaaaaggggagtcatcagtccaagctttaaatttatcttcagagctaaaattcagagcagatgtttttatgccctactcagctgacacagctcagacaggggtttgatttgatcaatcctatttgaaatttggaacttctcctgtccactaagaatataagttgtgtatccctttcctggagatctttaaaaagtggtgagaactctaatttcctgggttgaggggggcttacgcatttggacttctgagagacctgactgtgtgaggagcctgaggggagacagcaagaccatcacccttcccatctgcctagagcccttgctaaactgtggaaggggtgtaatattctgagtttaagaaagcaaactgtctttaaaaaagagcccccacttttccctggcacagggtgcatttggagtctagacaagattgaatattatcccccaaaatgtatatccacccagaacttgtaactgtgaccttctggggaaacaaggtttttatagatgtaatcaagtcaggatgagaccatcctggattagggtgggtgttaaatccaatatgactggtatccttataagaagagggaacttcagacagacagacgcagacatacagagacgtccatgtgaagacagaggcagaaactggagtgatgctgctaggagtcaaggaacactgaggatgccagcagccacaagaagctggaagagacgaggaaggatcctaccctggagccttcagacggaggatggctctggcaacaccttttgattttacatttctgacttccagaactgggagggcataaaatctgttgtttttttttgtttgtttgtttgttttttttttgagatggagtctcactctgtcgcccaggctggagtgcagtggcacaatctctgctcactgcaacctctgcctcctgggttcaagcgattcccctgcctcagcctcccatgtagctggcactacaagggcccgccaccatgcccagctgattttttttattattatttttagtagagatggggtttcaccgtgttagccaggatggtctcgatctcctgacctcgtgatccggctgcctcggcctcccaaagtgctaggattacaggccttagccactgcgcccggccaaatcctgttgttttaagccactcagtttgtggtactttgttatggcagccccagaaaactaatacagcatctgatgtgtccatgttggctgtactaagacagggccattgagacttgcctggccgtcttctgtggacagctttctagatgcacctaagtcaagtccctgaggcccaccgagccattattctgttctgggtcaccccccatggcctcaccctcactgtcttgcctttcattaaacatgcacttgtgagcgataaaaaaaaaaaagaatggaggcattgtacataaatatttgatgatatagcctatttaaaatttagatagcatcttttcccacaatctcaatgatttcatttttttttcagttgttaaatcagctaaaattgtatccaactactataatatagtattaattactgtacaatataagagaaaatggaggcaataatcattgaattggcattttggatttcaggagacataaaaatcatttaacacctgttttattttagagataaaagaactgagaactatgaaattatcacagctagttagcagagttggaatcaggaactaaattctctgttaaaaagcaataactttagatcataagtggtcaacctgtgctagccattctatgaaatttgtgtactctgtggataattttaagattaatgttgggttttacctattctggtcataatcctattctgcttttggtctacatggcatctttcagtaagatagatcttccaaccacctcatcacatacagagtaaaatatggtctcccttgcttgccttacatactatttaacctcatgtattgctacctgaaaccaagcacttaattcttccttcagtgaagtactaagccatgtgtgtagtcctagttcccacccacacgtctgtccttatttgctgaactcttcctccgcttaatacactctttctccaaatcttcctctaatttatgtggacaattcttatttaatcgttgagatcatgatttgttttttttttttttttttttttttttttcagaaagctttttataagcttgacagaacttcaatgaacttgggctaaatgtttctattactgaaaaaatactttgtgaatattttaatattagtgtttaccacattattggaatatggtatctgtctgtccaactatgttgtaaatttcttcaaagaccagaaacacttgggctgaaacatcagtctccaacgattttttaaattgttcgtatgattttcataactccaaccatctcctgttgcttatgagttccaaatctctatgtcctttctggatctatctcttgagtaccaagatttaattccactgtatcgtgtaagcagtttcctcattacatatattacaatgcactgaatcatttgtttttaggttggacttatttatgtgcccctcagattattttgtataactaatttttatgtattcaaggcatgtacctgtttgcttagttattttttagtagattttatttttcagaggaattttatgttcacagcaaaatagagtgggaagtacagagttcccatatacctcctgtccccacacatgtacagccttcctcaatatcaacatcccacctcagagcggtacatgggttacaattgatgaggctacactgacacatttttataactcccaaatccatatcttacattcatgcttactcttggtgttgtacattctatgtgtttggacaaatacagaatgacatatatgcaccattcatgcagaatattttctctgccctcaaaattctctgtgctctgcctattcatccattcctccctgctctcctctggcaatcaatgatcttttcatcatctccatagttttgccttcttccaaaagtcatatcgttgaagtcatacagtatgtagctttttgaaatgggcttctttcatttagtaatatgtatttacggttcctctatttttttcacgtctcaataggtcatttccttttccattctattatctggatgtaccacagtttattcacctactgaagtatattttactgcttccaagttttggaaattatgaataaagctgctattgcttagttatttttcataatgcaaaaacacattataaatgattacaatatgcagaagtatatataaagcagtaagtactgatgtcgtgatctctcctttcctcctcatctgtattccactcaccacagatgatctgttaagagtttagtgtatatccttccaattaccttcaatgacaagtttattgaatatgtgaaccagcttaaggccaaagatgttactgaatttatccaaaacatgtattgaggcatgtagtaggctgaacaatggtcttcaaagatatcagctcctaaaccctggaacttgtcaatgttttatctgtgtttgcagttgtgattaagttaaaaatcttgagatggggagactatattttggattatctgggtgccctctgaatgctattacaaggatccttgtaagggagagacagagagattacccagactgaagaagagatagcaatgtgaccacagagatagagattggagtgatgcatccacacgtaaggaatgctggcagccaccagaaactgaagaggcaagatatggattctcaccgacagcctctggaatgagtgtgccataagccatctttggtttcaccgcagtgaaattaattttggattcctggtgtcagaactgtgagtgaagacatatctgttgttttaagtcactaagtttgtggtaatttgttatagcaatgactaatacaagtccttactgtgtttctgcactgggccatctggttcaggtaaaaagacaaatagaaaactggccttgactttgaaaactttggagtagagtttatatgacaggttggttatggcttgcaggtctatacaccagggtatggtgcttttgcatttcccagagatgaataaggagccagcagagattgtaaagcagggaagtggaatcatcacctttgtttctgagggagatgaagcagctggaagcagagacattaataagattatcactcatgaaacctgaggagagtttacactgtgaccgtggcagtagcaccaagaagaatcttgagtttaggagacttttctgaagtagacgtaaaaatatttggcaattacatcattttcgagtcatgttaccacgctgggccaaacatcttgtccctaataacgatttctgtagtgatatttgggttttttcctaactaaatcacagcagttctgcataaaaatattttgagtattggctgggcgtgatggctcatgcctgtaatcccagcacgttgggaggctgaggcgggtgggtcacgaggtcaggagttggagaccagcctgaccaacatggtgaaatcccatttctacgaaaaatacaaaaaaaatttagctgggcgtggtggcgcatgtctgtaatcccagctgctcaggaggctgaggcaggagaatcttttgaacccgggaggcggaggttgctgtgagccaagaacatgccactgcactccagcctgagcaaaagagcgagattccatctcaaaataataataataaaaataaataaataaaataaaaaatgagtattattttgaaattttaaaaatcagggataatattcttttaaagatataatttttaaacaatctttttccaaattcttgatagtgtttattcttaatctataaaaaaagaagtaacacagaaatttatatcacacacaactttcatcaaggaaagattactaatatggtgattttattttagctgaactcaaatatcactcgaatgatgaatcaaattaatgtgaaaagtcataactatcttagtattaaacctcagagaaaagaatgtaagattaaattaatagcattttaagtatatattgatggaatcatttttccaataaatagactagtcagattaagaagcagtgagtttttagtgcatcattatgaagaataagtgcaaattttgttcaaatgaaatgaataaacatgcagtcacaaccaggctgctctgtattcctagtaataattactatataaaaggttaataaatgtcaagtaaaagcagctatgacctgcctaaaggttaagctgaaaacagctaaaatggaaaaaaagagagtgcagattattacgtttattgactgacactggttcttagagaacagacaattctggaatgattaattgataattaaatttcaaacaagtacctttaacctctaaacatgaagataattcaaggtccctaccagactcatactgcctattaatgtacttcccttcaccctgttttctgagaattagcaaagtctgtggctagttttttttctgagtatcttcacaacatgttgaattaatgaagaagatatccccaactagatcctcaaggcacagggttggggcaggcagggcaccaaatgtcactctcctttctaaaatctagcagagatttccagagtggaaatgatgccaaacatttggcttgggatataaggtactttatgatatgaatctgccttcatttttaactttctttttcacaactccttccaaatcccatactgcagctagtaaactacttactgttcccccactaatgccacaattttgcctgtacccagaacactatgtcccttcttcaaaggctgggccaattcctgtttatgcctcaggattcattcaggctgcctcttctggaaagtgttctttgatccttccaggtaacatttctttctcatagcactgagcacagtgcaccctcattttaggtttactcatgcctctcccttgctcaactgtaaggcctgttaggacagatgctgactcatatgctctatatatcaagaatatttatagcagagtgttttgcccctgccaggtgcttgatgaatgtttgttgaataaatagattccttaaggagtaaagagaagatattcagtaacaaaggaaagaggagtagcctttttgttaattttggctgaaatctacatttatagcataagtttgtaagaatatttttcagtgaaaggacacctactcatttacctattgtcaattgatggcctttttttccttagtgcagtaattggaaaataatcacgtagagctacggtttgctttgtaccttcctatgaagtcaaacctgtttagattttttttacctgctacttctttctagcatggctattaaaaaacacaatcttttttcatgacattgaacagcctgcaggtattatttacttatttatccttagcacagaataataacaataaaaatgcaataacaaatgcattagtagaagttcatgttaggtatattaaaatatatacagttttggtggtgccttgttgggaaatgcccttgctttataataaccctcattatctaccagaaaataagtacaatgggggagggggtgtgaagtccaagagaaatcaaattacacttaatttctcttaatagcaaacaagaacattcggctttttaaaaatagcacacaactttcccatatatttagaactcaagcagatcttaaggattgaggctgtgcacacgcacagcagagcttacagaagtcccaggtcactcacctctccccagctgacagaacctgcacacaggtgtagaggagatatcagagaacttggtgaggagttaaaagcagggaaagagtgaaaaattatgtaaagtttaatgtgcttcacattcatacacagatccatcagcagaaaatggaaggcttattggcttgaggtgttggagtgaaagctctgatttttttttctttgctgaatgataagctatacaaatacaggaatgacctacaggaaggcaagcttaaaaataaaacaacaactgaacaaagatattggtagctgcacattctggaggagacagacgtcataaatttaggcaagtttactaaacaaatggaagaaaacaacaaccgtgaggtggaaaatagaatccagagttgctacaatatatcatataaaaaggccagtactcaacaaaaaaagtatgagacctgcaaagaaacaacctgtgatacatatttagactatagaagtcgtcagtagaaattatctctgagtgtcctcagatattagatatagcatacaaacagtcaaaagcagctgttataagtatgtccaaataactaaagaaaattgtgatggcaaccacttagtgaatataaaaccccagtgaagagttagaaattattttaaaaatagagaatcaaatggaaattctgtagttgaaatgtacaaagacaaataaaaaatgcaccagagggcttcaacagaaactgagatgttagaagaaatagtcaataaatgtgaagatagacagagattatctaaactgaagaatagaatgaaaaaggattgaagtgaaataaacatactgttcgagatgtataggataatatgaactatacagacacatgtgtaatgcaccgaggagagcaaataaaggcccctagaactttttgaagaaaaagtggctaaaaacttttcaaatcgtatgaagaatataactttacaaatccaagaagtttaatgaaccccagttagaataaacacaaaattatctacaactagacatacaatagtcactgttgaaagctaaatccaaagaaaaaaacttgaaagcagcaagagaaagccaactcttcaaatatagggaacaaatattactaatagctaacttctcattagagataatggaagccagtcagcactggaataagatacaagttgaatatcccttatccgacatgtttgggatctgaactatttcaaattttggattttttgaactttggaatattttcattagacttactgttcagcatccctaatccaaaaaccagaatccaaaataagtttcagattttgaagcatttcagattttggatttttatttatttatttattatttaattgagacagagtctcactctgttgcccaggttggagtgcagtggcacaatcttggctcactgcaacttctgcccccctggttcaagtgacccttctgccccacccttctaagcagctaggattacaggtacccaccaccacacttggctaatttttatattgtttagtagagatggggtttcaccaggttggccaggctggtcttgaactcctgtcctcaaatgatcttcctgtcttggcctcccaaagtgctgggattacaagcatgaggcaccgtgcctagcccttggatttttagattagggatagtcaacttgtattcacattgctgaaaaaaccaaaccaaaaaaaattctgattgtcaatcagaattttatgcccagcaaaaactatttttcaaaatgaaagtgaaataaagacattatagataaataaagactgagaatttcttgttagtagaaatattaaaggaattctttcaggctggcaacttaagtcctcaggaagaaacaagtgtactggaaatggtaaatgtgcagcaaacaaagggatctatattttttctcatttcatctttaaacttctttaagagaaaataaaattgtataaagcagtaattataacattgtattttttgggttacaacatataaatgtatattatgtatgataataataatgaaaagtttgggaggaaaaaagctataaaagagaaaagtttataatttttattggaattacattagtattctgaaatagattgtggtaaattaagatgcacattgtaatccctaaaaaacactaagaaaataatacaaaataatataaaaaatccaaaagggaattcaaatagtatgctaaaaatattgactgtagaataaggcataaaaatggcaatagagcaagagtttactgaaagaggggcatgggcggtaacagtatatgaataaagatgtaggttgcttatggaggtttgttggaagttctcttctgattatgtataccagggtaattggctaagcatgaagtaggggagaaggtgctaggtgttagagaagaaaggagaagtactaaatgtcacctaggagaaggaaagagtgaatagctttgggaaatttaagattttggaggtgcactaaggatccatcagaagttggtaattatgaatttaatgcgcaaccagttgtcacagtcatatattttttgccagactaggtcagctttacaggtgtaggtgcagtggaggagaaagaaacacagatttgaggttatatggaagaatgaacatattgatcaaatatggaatctaagctgggagtggaatctgagctcatgaggaagaaaaaatatccttcacgctaatacatgtgaggggtaggaaggtcatcaagctggagattcagggagttgagaaacaatgtgagcaaaagcatagagtagaaataaacacaatatgtaaaggaaaggaatgagttagacctgactgatgtgataggtatggaaagggaaatttgtaagaataaaattggttagggaatatagactgaaatggcacttaggtacttaacttcattgtttctctagtttatctatctaataatctttggtggcaatgaggcctaacctgaacctatgtcaaatggaatactcttcccttgctacccctgccttgtgaaagcacttctccttccctttaccctagtccccctaccccgctacacttataactttctcataacttaccaatttatggtttcttttctacccctaggatgtaagctccatgaaagcagggatgttttgtctgttttattcagtctatagaacaggaccctggatgtagtcttccccaatagatattgatggaacgcagacaggaggtatcctcttgtgcagaaatagctatcaggtgaggcagattagaaaatggacatggtcaatgactccaatttagtctcactgtgtgagaaggacacacaaaagactgtaggtagaatctaagatgttctgaaaaggtgaaattatacaaacatctttatttataaccctcgattttgtccttttctacatatagccctcctcctgccaaaagcttactttaaggcaaagataactagcgttgctccagtcttatccactgtttatttttctatagcttttctcatgtagtgtcttaaatatatgaagagttccatttgtaatcatggcagccagaagtgggcctgcgaggctcagctctcttttctgcttggctggggccctgtgtctcaactgtccttgcttcatgctcttggagtagtaaaggatgtgcagcttgtgtttcctctgaatgactccttgacccgagttgtttccagtaactcagtctgatacatttatttctcatattcatcttaatacattcttactttgacttacccaacctttttttttctatcttcacactatagtgacccttgttatgacttagcaactgatgatatagcaatgtatccatgcccgatagctcccaagattagcagtttaagcataggttagggttcaatatacctggaagcatgcacactcaacctgggaaagcagtgtcaggccttcggctcctcatcctggataataggggaagtctttcaaaattgattcaatgctgtagaaaatggtgaccttccaaatcacctctgggaagatgagcaagtattaactgggaacttaggccagataatgggactctcctctctgcagttcttggggaaggaactgagaggtgtctgtcatgaagccatggaaagacgagcctcagggcccttcacttgcataagttttgcctggagaagcaacaggcattttgtatttgctattctgaattatttttcttagaagcctctccaaattgcaaagcttcagggactgacaagatctagatctggaagaaatttttgtatgagtcaaaccagacaaattagaaaggcctcttttgcatctgtggtaaaatacacataccataaaattcactgtttaaaccattctaaagtgtatagttcagtggcatttagtacattcacattgttgtgcaactgtcaccactatctagttctagaatatttttatcaccccaaaggaaacaccatgcccattaagcagtcactcgtcatttcctgctggctcctgtcctctgcgatcactaatctgctttctgtttctatgggtttacctagtatggatgtttcatataaatggaattcaacatgtggccttttgtgtctgtgtctggcttttctcacttagcatgttttcaaggcttcaaggcttatccatgtcgtagcatgtatcagtactttgttcccttttatgtggaaaggcctttaaataaaagatcattttagagaggatgtagccagttaaataaggggatttctttttttttcttttttttttttttttttgagacggagtctcgctctgtcacccaggctggagtgcggtggcacaatctcggctcgctgcaagctctgcctcccaggttcacgccattctcctgcctcagcctcctgagtagctgggattacaggcgcccgccaccacgcccggctaattttttgtattttttagtagagatggggtttcaccatgttagccaggatggtctccatctcctgacctcgtgatccacccgcctctgcctcccaaagtgctgggattacaggcgtaagccaccgcgcctggccaaataaggggatttcaggagtaaaatttaatagaatgactcaaatactatcagcggcacattttatggtactgtattgtgttaaattctctaacccagtggactagaatttgcctgtcgattttgatctttacactgattccaaccaaacgatcatggctaacctgtaagcttttcttgacatatacctattctgctcagaaataattttgtgtcagttgtctctcctactcctatccccgttatggcctttcttgtctgggtcagcatccagactaagctggataattgaaattccagaaaaaaacatttctcctgattttagtgaggacatttgaaaataacctacgtgttgctcaatccctgaagctcatttgaatgtctgctcttatatttaaaaagcaatgtatgccacctggaagcaaaaaataactgtagtttgctaatgttgtcactatgctgcgtcaatctctaatttgttataaaatgtaggaagatatttcgagtaagagggtgtctacctcaattcttcaaaattatacccagttttccttgttatgaagcataattactttacaaagctataaaatgccataaagttttagtaattcacttagcatttcattcactatatttttagtctactgtactgcaaaggttgaaagacattttatgttttatctgaggtgccatccacaaattacggcacctattatgcaaataatgcctgcaaaagaagtctgctgcatttataatagggcagcttattagaatttggcttgattttctttataccttgcttctcatctcttgctataactgtgtccattgtcagtgagatgctagtataatcttcatgtttattcaaaccaaagcctctaaatacatacattttagattttggattcaaatgatggcctagtttagtttctgtgttagaacttaagtattctgtatttgcaccttactgaacgcttttgaaaagcttttagttctaatgttacattttagcattatttaaaatttcataacattttacttatattagctttgcaaatctcctgtattgcttgggtaacagaggtatgatagtaaaatcagcttctatctgtttagctcattgagaatgatgagggtaaaactgttcccaaggagtgaaaactgtttcttgcttttatacatatatataaaaacacagatatacatatactatgtaaacatatattcggtatattgatcatattgaaatatcttggatgggtcagttaagaaaaaaaaaacctaaaaaaaggacctggaggggagcaataatgaaaaaacaatagactgaggaacactggtctagctctttaaagtttcatagtgtgtttatccttactacttcttttgacaggaaagccaagattgcatagtgtgtacacagcagatccatgcctggactctggtgttctatttccataactgtgcttctcctgctgtggcatgtagacttagactagggcttgatgggctcttgcaaggaagaaatatcttccttgttaccttttctttcaggcctagtttataaattaagaatattgggtcctcaaacttatcaagtttattcgttttcccctttctttctaatatatgtgaggcctatacctctcctttggcttaagtggggcccatatatctctagatttacaaaggccatggataaagacaagtgtagacacatggctgtgggagtgaggggattgcttctatcccccatgatccaaatcactttggatcttcaggatcaaggattcctaaagctttgaggtactcaatttttgtctccttttcctctttctaaccctcaagatctcctaagccagtttctgattttagtaataacatggtctctaagaacccatagatatagcccttttctgtgttcctctttacgacagtccaaatattttaaactatctcctcttagcataacttgaatatataagtaccaaggcattcatttttttatctgtataaatttaagggacaaaagtgcagttttgtttcatgaatagtggtgaagtctgggcttttagtgtatctaccacccaaataatgtatgttgttcccattaagtaatttctcatctcttactcccctcttaccttccacccttctgcagctccagcgcctatcattccacactctgtgttcatgtgtatacattatttagctcccacttataagtgagaacatgtaatatttgccttttgtttgagttgtttcacttatgataatggccttcagtgccatacatgctgctgaaaaagacatgatttcattcttttttatgcctgaatagtattgactgtatatatgtacacacacacacacacacacaaacgtatatatatatatatatatacgtttgtgtgtgtgtgtgtgtgtgtgtgtgtgtaaatatatctgtctcagtctctatcaatctataacattggccagtcatcacatgatagacaggttgattccacatctttgctattgtggatagtgctgtgataaacatacaagtgcagatatcaaatgtttaacaagcatatgaaaaaatactcaacattgctaatcatcaagaatgcaaattaaaaccacacgagataccatcttatacagttagaatggctattattaaaaagacaaaaatttaaaaatgctgatgaggatgcagagaaaaggaatacttatacacttttggtaaatgtaaattagtacaacctctatggaaaacagtataaagatttctcaaagaactactcattgccttggaaaaggcattatttttgtttgttcttttttatttttttgagatggagtctcgttctattgcctaggctggagtgcagtggtgcgatcttggctcactgcaacctccacatcccgggttcaagtgattctcctgcctcagcctcctgagtagctgggattacaggcacccaccaccacgctcggctaatttttgtaattttagtagagatggggtttcacaatgttagccaggctagtctcgaactcctgacctcaggttatccgccctcctacgcctcccacagtgctgggattacagatgttagccgctgcacctagctagaaaagacattcatttttaataaaccatcattttctatctaaatggctattttctatctaaatggctatagcatcagccctgacctcacttcttcactaaagagagaatagggagtggaaaaagatgtttctgggactgaaagaaaatttctgctttatataatttgctactaaacctaagactgtttcaggggaatggtgggatcattgaaggctattttttttttaaggggaagcagaatacaagatgtgaacactggattattggctgtgcttataatgttaaacgtgaggtgagatatggaggaaatgaggctgaaaaggcccatagagccaggtcatgaaggggatgcatatgcgaagatgagaaatttgggttttattctgtagggcagtggttctgaaaatgccctctatgtggccttctgatttttatggaaatccttaatatatcaccacagagggcaaaaaggaatagcaagtgaatgaaactcttggtttcctaactcattttatcagcacaatccattcctgtctgtgttttcttccaattgatcaatctatcatttatctatcatctatttcacactctattactctctctatatatttttaatttactaggcccacatataagaatgtctttgcaaataaaatctaccgacatatatttctgactggataatttggctaatacattcatcaggaaactgaatacgctggtaccccagttctagtggtatgctggagttggtttgtaccaacctactagaggcaattgttaaatttcaggaattttgaatgctggttgacatcaagttggtatcttgaagttgattgtggttgggatatcaaaccagtgaaatcagcaaatgctacaaatcagatactttttccccacatcctccttgcagagagctgcttgttaaacctttactaacacgccgcttccagttctcaaactttggtgcatgttaaaattaactggggaggtgtaagaaattctggtgtctgagccacccccagaaattcctattaagctggtagaaggtgtcatctggacatcaggactatcaaaatcttccccaggtaattctaataagcactgaagtttgagaaccatgacactacatacagctcaagatagatgtcaatgttgtgtattgatttggaagtcaaggtcatgaagtgatatttttaaaaatgagggaggatgacacctctaaaagaaaacatgtcaagagaaaagtgcagtgagccaaggatggaaccccaaggaatattgttgcttaaggggtggacgaaggaggaagaggaggagcttaaaagaagactgaaaaatgggagaaacggaagaaaataatattacagaaatcaatgatttagagtttccagccccataagatagaattaagcaatagcaggaatattttgctccccacaagtactttccaactattaagactttctcaaatagaataggccacttaaagaaggaacccagaagccaaatgactaaatgtcagtggtggtgttgaaagcatccctcactgaaggggaggttggggctactgataaagaactttcagactgaagggatgctaaaatttaatgactatgtaatcagacacaggcgattctgatttaatttgagatggaattctgtgtaccgaaaggtcatggtaaaaataaatagaaaaaaagtcattccaagtctttggaattgtgtactttaactctttataagcaaacatgtctgccaaatggcccctagttgtcttttcctttggttcaatgctgtaatgccggttttcatggcttctgtgttgtattgtggttttactgccattggtcttgtgttactaattgtacttaccatacagaagaaatttcacattaatatcaggactaaaactcttttaaatcatgttgatatattagatagttttgaatggcaattacttttaaattttgccagggcataataaatctatttcaagtgtaccttttttttcctctaaaacaagaaaatgagagagttaaaatatttatattattagcattttaaaagaagttttccactattattttctgtatttgtgtgatttattggcttgaagttatggcaaaattattttagatagcagttgttaattactcagcattaattaaatgaagtgaaaaaagaaataaaacatatttctcagaatgacttctattcatggcaagttacttgattctggtttcccaaaacaatatgctttatcagtgagagagaaacaaacatttggtttgaacttggctgttcacagattatgatattgcttagcaaagcagaaaattatgaaatctaggttgaagtcattggttaaaaaaaaaaaaaagcccctgatgtaaatgcatttgcacacatttcaattgcagtcgcttttcccacaaatcagctttatcagctccattagcagttgacgccaataaaaatctgaggtcaacttcctgctggttggttcttaagtgtcagaaataatatattctgtgttacaaatgtcccagaggtatatatgtctgctccttccaacactgctataacttattctccagcataaacatctgcccttatgctcattaaaagttgctcttaaaaataggaaatcaagtaaaaacaaactaataagtgaacagcctgacacaggctaactgccaagaacagattggttctgtattcagaactcccactgacatcagacttggcttgggttttattcatattattttccattcatttatttgtttatttaatattttacatcataattgataatccttgagcaatgaaactaaaaattatcaaaactttggacagtatgacctgggtcattccttgttagatattatggtctccttttttctttcttcatctaaagatacagtctggcatagattcaaattttttaggttaaatacaaatatttttcctttgacaattttaaaaattaattatactaattggagataccatgaggttttataactccagatctggaaatctgaggaaaacacaaaacaaatagtacttggccaactatgtccttcttatgtatctcaaatttaacaagtatttattgaacatctatgtgttgagtatgtgcaaagatgagtaaaacatgtaccctatccttaaggagctaatgatttaaaggacaagatagatgtaaactagtaatcataataagtgcaatcattaagatactcagaaagcccaagttttatttatttttatttttattaagttttgctgatatagttcatgcagatccttgaagccctagatttagatctgtctctcgggatttgcaaagttgtagagaggaagggagagaggaacagtgcataagcaggagctttgcattttctatttcttaccattttatacctctatttcaatatctttatagtgaagcatcctttttgtcgtaagtctctccatgttgctaggatttttcactggctaccctgatggctttgtttagtactcaaatttctaggccagggctattcaatatgcagataatgtgaaccacatataaaattttaaatattctaatagccacattataaaaaataaaaaacaggtgaaattaattttaataatatattctttttaacccgatagaccccaaacattattattgcaacatataatcaatatttaaaagactgttaatgatatattttacttttaaaaaatgtccagtgtgtattttacacttagagcacaactcaattcagactagccaaaattcaaatgcttaatagttgcatcagtgatatggtttagatgtgtgtccctgccaaaatctcttatgttgaaatgtaatccccaatgttggaggggggcctggtggaggtggttggattatgggggtggatttctcatgaatggtttaccaccatcccctgggtgctgttctggtgttagtgagagagttctcatgagatctggtcgtttagaagtgtgcagcactccccacccgcccccccgacttgctcctactccccctttgccttccaccatgtttggaagcttcctgaggcctccccagaagcagaagccatgatgcttcctgtgtagccctcagaactgtgagccaattagacaaacctcttttctttataaattacccagtgtcaggaatttacagcagtgcaagaatggactaatacagtgaggttagcagatactgtgttagacgacacagttctagatatttaactctttagggtttcttttttatctatttattcctttgtgtgtaaatgaactttgacaacttgccagatagctttttctcaggctgaaccagggaaagtcattttttcatatcccctaaagggagccagaaagcaactctatgagagttataaatgtctcagttgttttagctctcaattcttgcaaacactggagagttttcatatttcctttccccatccataagattactccaggcacttggatgtaggagaaagaagaaaactgacatgtgaactgttcattttgtataaatatatgtgctaacaattattgagatagaatttatatacaataaaattcactcatttaaggcatacagttcaatggtttttagtgcacatatagagttgtgcaaataccatcatccaatttcagaacatttttgtcattttaaacagaagctccatgcccattatcatgcactatacatacttcccatgtccttagttttaggcaactactcatctattttctgtctctatagatttgtctaatttgaaaatgtcatataaattgtatcattaaaaatgtttggcatatttcgcttagtattatttttaaaggttcattcatgctgtagcatgcatcagtacttcattccttttattattacaatagttttcttccgtatgtatataccacattttgtttatccattcatcagatgatggacctttgggtttacaccttttagttatgaacaatgctgctatgaatattcaggtacagacataccttgttttattgtgtcttgttttatcgtgcattgcagataatgtgttttttttgaaggtttgtggcaaccctacatcaagtctatcaatgtcatttttccaacagcgtatgcttctttctgtctctttgtgacattttggtaattctggtaatatttcaaactttttcattattacgtattttatggtagtctgtgattagtgatccctgatgttactattgtaattgttttcaggtgccacaaaccactcctatataagatggtgaacttaattgaaacatgttgtatgtattctgactgctccactgactgtctgctccccacatctctctctctaggactccctataccccaagacacaacaatattgaaattaggccaattaataaccctacaatgacctctaagtgtttaagtaaaagaaagagtctcacttaaactgtccaaatcactttaaatataaagctagaaatgatgaagtttagtgaggaaggcatgtagaaagctaagataggtagaaagctaggcctcttgcaccaaacagccaagttgtaaatgcaaaggaaaaattcttgaagggaatttaaaaaatccattgttcacacaaatgataaggcaaaacaaggccgggtgcagtggctcacgcctgtaatcccaggactttgggaggtcaaggtgggcagatcacctgaagtaaggagttcgagatcagcctggccaacagggtgaaaccccatctctactaaaatacaaaaattagttgggcatggttacaggagcctgtaatcccagctactcaggaggctgaggcaggagaatcacctgaactcgggaggcagagattccagtgagccaagattgcgccactgcactctagcctgggtgacagagcaagaccctgtctcaaccgtctcaaaaaaaaaaaaaaaaagcaaaacaactctattgctgatatggagcaagttttagtggtctggatagaaaaacaaaccagacaacattcctttaagccaaaagctaatccagagcagggccttaactcttttttgattgtatgaagcttgagagaggtgagaaagctacagaagaaaagtttgaagctagcagaggttggttcatgaggtttaaagaaagagccatctctataacgttaaagtgtaaggtgaagcagcaagtgctagtagaagctacagcatgttattcagaaaatctagctaatattattgatgaaggtggctacactaaacaatagatttttaaatgttgataaaatagccttatattgaaagaaggtgccatctaggactttctaagctagacagaagtcaatgcctgacttcaaaacttcaaaggacaagccaactttcttgttaggggctaatgcagctggtgactttaagttgaagccaatgctcatttaccatcctgaaaatcctagggcctttaagaattatgctaaagccattctgcttgtgctctacaaatggaacaatgaagcctgatgatagcacctctgtttacagcatggtttactgaatgttttaagcttactgttgagacctactgctcagaaaaaagattcctttcaaaatactgctactcattgacaatgcacctggttacccaaaagctttgttggagaggcacaaggagactagtgttttcatgcctgctgataaaccatatattctgtagcccatgaattaaggagtattttgacattcaagtcttattatttaacaaatgtatttttgtaaggctatagctgccataaatagtgattcctctgatggactaggcaaagtcagttgaaacctttctggaaagaattcaccattctatatgccattaagaatacctatgattcatgggaggtggtcagaatagcaacattaacaggagtatggaagaagttgattccagtactcatggatgactttgaggggttcagaacttcagtggaggaagtaattgcagatgtggtgaaaaagcaagagaactagaattagaattggagcctgaagatgtgactgaattgctgcaatctcatgatagaactttaatgaatgtgaagttgcttcttatgaatgagcaaagatgttggtcccttgagatggaatctactcctggtgaagttgatgtaaacgttactgaaatgacaacaaaggattcagagtatacagaaatttagttgataaagcagtggtaggatttgaaacaagttctgctatgggtaaaatgctatcaaacagcatcacatgctacaaagaaatgtttcttaaaaggaagatttaattgatttggcaaactttactgttgtcttattttaagaaattgtcactgccatctcaacattcagcaaccactatcctgctcagtcagcagccatcaacatccagacaagaccctctacctgcggaaagatgacaacacactgaaggctcagatgattgttggcatatattttcattttattctggtataaatgtagtagtggaaacttctctccgaagtggctgcaccatttcatcagcaatgtatgaaaattcaattttctcatatccttgccttaactgttattgtctataattttgactacagctatcctagtggatgtgaaatggtatctcattgtggttttggtctttgtttccctaatgctaatgatgttaagcatttattttcttgtgctttttggccatttgtgtgtttctttggaaaaatgtctattcgaattttttacccatttgaaatttgatgatttgtcttttcattgttgttttgtgagagtttttttaaaaatatatattctggatacaagttcttcatcagatatataatttgtacatactttctcccattctgtgggttgtcttttcattttcttgatggcatccttgaaacacaaatgttttaaattttgatgaaatgcaattatctttttctctcttgttatgtccgatttgctgttgtagcatacgttatatttacaccatctttgtgcatgactaaaacatagccatagcctctgtttgctggagtcgatggagaaaagcagcaatgaaacatgcagtgacagtaaagcaagaagttccaggtgctgtgtatttaccccacaggaacaattaatcttgtctcatgttagtgagaggacacggaatgtttcagaagggacaatttagaagctgacaggtcaggaagtgttatttaacagtgaggaaaggaaagaatttagttatgtgtactgttcatgacggcaatataaaaatttttcaaagatatttgtgttatgaaattccttggtttctgatacaagcagtgtcatgtaactgtgtgtgcatgtgtacacgtgcacgcgcgtgcatgtgcacatgtatgtgtttagagaatgcacttcaggatcttgcaacccagctcagggccatctttctgaaggtcagttgttggtctggctaagcatagaaatactggttgatagaagtagctgatagaatagtggaaaaagtcatacaaggacaaagctacataatctgctctcactgtagttaagaccttaatatttatactaaagctaactgcaaacaacctctgtatatttggaaaaatacactgtgtccaagagtcttttaaaggctttggcattttcctctgttcatgctaaaagacatagcaacaggataaggaacagtctcaccttcaacttttgtacttgaccaaccccagttcttacctttctttatgtattttaaaatccgtttagataaatgcataacttatgaacactgggaaaaattgtggataaaatgttcttaaaattattgtttgtaccaaatgtcaaatggcaggaattgaaattaaaacagacatgaaataggcaataaaggtaaaatcaataaagtagatttcacaaaaggctgagttacacagcttttatgatgagtccaatttttagggtagacagaaccctggggatgtatgctcccattggtgtgtaggcatcactccgatttactttaatgagccttatcagcgggaaacaagggaaaatagattcttcagctctcctttcctattgccggctccaaagcccttaacaaagtacacaccatgcattagtttggggtactattcagataagagtcactcagcaaggaaagtattcaaaatcctgcaaagccttgttttgtatattgttcaggagatccagttagtacataaacagttattctctgtactagagtgtctttatcccaggctgtgcagatttaagaattacctcaaggcaatctgtaatgcagataatattggcaactaagtgcaaatgcagataaaagattgcataaataatactcctgatgggaattaccgcataacatttatagtaggatccatgccatcctttgtaatctgatgctatataatgccatgagattacgtgattaatttagataagcagcattactgaaatattttatatttagttactacattaaagaaaaatagtatcctaaaatctaggtggtttattaacatgaacgcattgattataattttgaatactaggttgcatgcctacttaatatggtaattcttcttgcttctttgaccattagttcaattccatagatgaaaattgcatttccaccctgtaacatagacattgtgttacatgctaagatgcaaaatgagcaatatcctggagatatttcattggcaataggtgctcatcctaaggagctcatccacagatctgcctgtgagtccagaaagcaactcagcctggtcatgcagtatcagtaaagagtccaagaagatgacacagagccaaatcttcaagctgagggagaattagccaggtggcagcaagggtattcaaagccagcagcactcacctcacttattataagtgctgtatatcatttccgtcgaaacaagtacatttccatttaaaaggtaattataactaactaaagaggtagagaaatgctacactaagcaagtgctaaacaagtgtagcatttttctgcctccttaattagttacaagcacctttgtaagaaagaagcaaagtacacattccttattttattaagtcatgtaaaagctttcaggagtggctgctccagtccaatacatttgcaagaatttgtagagaatcctttgcaagcctggcattaggcttacattcagggtaattgggtacccagggctataatacacttaactttcagcagcgactttcttcaaagctgtgctctgaggccatttttctagtctaagaaaactaggagaaggaaagtaagtaaattttggggagaaaggagcagggcatcgctgaggaatgcagggcagcaaccatggtcccaaaggaaggtagcagtgagtttggggcaggtattgacaggctggatgggaagaccacatgagtagtgggcaacagaagtggagagaagtgtgtgtgtgagggtggctcaggggcggggaagaaggaaggggaaaagggaacagactttttttttttttttttttttttgtgcagcctgagaggttgttttagtccaacttcataagactgaaatattttgcttcagattttactgaaaaaaaaaaatcccaacccacacatccttcttcaaactggataaaggtataatttccagtcccctttgtatctaattcaaattgtaattttatttcctatctcccttgatggcaaaatgtagacaagagagtttggaaagcaggcataaaatgatattaaactgtgacatagacttaatttaatctcccaggccagctcttctgggggactgggggaaggtttggcaatccctctcttgacctggtcagcactccgcatcctgggatgatttccctaggtgaaaggaaagtggcgaagccacagttactgctggtacttgccaacaaaacttcctctgcttgctacacacgtccactctgttttctttacactcaccccaggagcttttagatccagcagtatgtttcacataattttttgtgtgctgcagcagcagtttcatctttatttagcaagactgtacagtccgactgccacattcccatgaaacatgtggttaattatccacctttccacatattgggatgtgtggctctacgtaaattgcgtaaatcaagttgttgtttgttttctgactcctctggcaaacaataacttgtatctgttttatttttggttaccaatgatttgaagaaagtctatctacctatcatctatctagtttgtgtgtatctgtgtgtagttttagtaacgcacttacagttttagtaaaatatggaatattaaaggtttgattagtagcattccaaagccttttttttttaatagaatgcacttttaaagataaaggatatgcagtttattgtccttttccacctgctccacaggtctgttattttcctcctgtccttttctctgtccagggagctgacccttctccattcctcccctaagatctcctactggtggattctgataaagtttagttagtgagaggcaccagcaagagaccagagggtaggaggaaagagaagtcagtgtattttcctccctgccctgggccatgttttctggaaggttctgtctcctttagacaacaactcctgttctcacagcttcacagcttcagttttcactgggctcccacaaacagtatttccttcccgttggctctaggagtggcaaaaacttctccttcctgatgatctccaagtgtctagtttacttcttgtttcccttaacactccaacaggtgtgaaaataaaattcagggaagtctgttgaaccacatgagttggattcagcttcctgacaggaccctgactgctgtaaggggagtactttccaaaaaaacaaacttttgagttttcagaaaacaatcatcttccaggcactcaaacattgggaatgtctaatttcacacttggtccacctaggacaggccgtgtggctgtgtgtgatgagcactggaaagggagtggagaaactctttgtgacctcagataaggccctcacaccatcctatggactgtcttcttcttcttctttcttccttttttttttttggagacagagtctcactctgttgcccaggctggagtgcagtggcgcgatctcggctcactgcaagttccgcctcccgggttcacgccattctcctgcctcagcgtcctgagtagctgggactacaggcactggccaccacacctggctaattttgtttttgtatttttagtagagacagggtttcaccgtgttaaccaggatggtctcactctcttgacctcgtgatctgcccgcctcggcatcccaaagtgctgggattacaggcgtgagccaccgcgccggccatgggctgtcttcttatctgcagttgagaactggttacccgctgcactgtgtgactgtggagggcacaagatgcaccatgtgccaaagcacttcgaaaaatatgaagagttaagccatgaaaccctgtgtggtgtttctgtggctctgtccatgttgtgctgttgatcctcattctttctactccccgttctactagctgctctttatgattttgcatttctgcatgtcattaattaaagtttagatttccgttttagtttaaattaattacagatatcctggtagtatggttttgtgattgggtgactgggtttggacatatgcggtggcaattcttgctggttcacactcccgctgacgcatctgtgactcgatctttgggactttgggccccggcatgtgctgtgtagcttctggtgggctttgtttccttatggataaaatcataatagtaacacctaccaagtattcctcacagggatgatgtaaagagataatgaaaaagtgttagagcatttttgaaatcaataggaacaatatcattattaggaaccccagtgggtttcagtttcctcttctacaaaattggaaatatagaatggaaagtgttgagaggtccattcaaacatcaacattcttaagatttgtgtctcacagttttgagaagattttaccaaagacaaaaaatggcattattaacacacatcttctatgagcaatgcatggaaaaggtaggtattcgtaaggagataaagttaaaaggaggtcatataagtgggggcctaacctaataagactgtggccttataagaaaagaaagggagagagatttacacacacagccttcgaggaaaggctgtgtggagcaagaaggtggccctctgtaaaacaagaagagagtccccagaacccagccattctggcaacctgaccttgaacttccagcctccaaaactgtgagaaaacaaatattcattgtttaaatcactccatctatggtatttttgttatggtaactcaagctggctaatacatttagatttgttattatagattattaacaactttgaaaatttttcaggtcttgcctggtacagtggctcacgcctgtaatcccagaactttgggaggccgaagcaggcagatctcttgaagtcaggagttcaagacaagcctggccaacatggtaaaaccctgtctctactaaaaatacaaaaattagctgggcatggtggcaggtgcctgtaatcccaactacttgggaggctgaggcaggagaatcatgtgaacctgggaggcggaggttgcagtgagccaagatcatgccactgcactccagcctgggtgacagaatgagactctgcctcaaaaaaaaattcaggtctagggagagaagataattaggcatgtctcaaaagaaaaaggactacgctataatgagtttaaataaaaataaaaatgtaacttctcatacctcactattaattttcctttcataagatgcgtcattgtttgtcctcaatgtagaaaaattggttcttgtgggagctagcctaattttgagagagtgattttataaagctatctaaaggtaattttctattaatctaacatgattcattttagaacactaactctgatatctaatccaaaaagcagggtatatgttaaaaggcacccaggattgggagccagctgacctcatttctagtcttgccttgacaaatactgacgttgtgactttgaagaagtcattttatccctcaggcctcaatgtcctcatctgaaaaataaaagattagtactcgaatggtgtctggggtccctttgagttgtcacactttataaatgtgtacatcaatgcattgtaagtttgctaaagtaatgtttcagtctgaaagatgccataggctgttataggatgctgtaaaaataatgcttataggtcttctaagaataggaaaatatattaattgtacttttatttttttagtgtgttaatttcattcccctagaatagaaaataaaatactatacttttaaaattacaagacaaaagggacaaaatccacgtgttcttttttcaagaacattttatgcaaatatgccatttaaaaaatgttgctatactacccaccatacactaggtggaagcaaagagtaagttaacgtgtaaaagtttagacagtattacggtaaacgaaccacaattttctggatagtaaaggtcattaaaattataggttatatttcttttttaaagatgctaattagaaaagaaaatagcaaataacactgcctacttaagcctttgatactaagatgtactactgtttaagccaaatctttaaaaaatttttataagaaaaaaattatatttaatactttcaacatttattttagattcagagggtacatgtgcagatttgttacctgggtatattgcgtgatgctgaggttgggagtacgactggtcctttcacccaggtactgagcatagtacacaatagtttttcaacctttgtcctcctccttctctcccccgtctatggtccccagtgtctattgatgccatctttatgtctatgagtacccattgtttagcttccactcataagtgagaacatgcggtatttggctttctgttcctgcattaatttgcttagaataatgtaagcctaacctttactctccttatagactctggctggtaccataaaaaattaaatactaaatcctttatcttaatttctagaatctgattggtcaataaacataatgaaataaccagtcaaatggttctattcatagatctcttttttttttcaaaagcttacagagaaaatgcataataaattcaaaaaggaattctctaaagcttatgctattttgaattcagtgatgggaaggaaatttacctcactgcatatgattttacatgtcacttctttaaaaagttgtatagctacttcttcctctcagaattaattgggtcttatgctacagtttctaaaatgtgaaatgatggggtgattgccatgttacaagcctaaacatgacttatgttttcaggcttatagtgaatcaaaactcagtttaataccagtttctatgcaaagtgaattgctcagagctacccttgaaatgcttcgtgtggaaaaagaagagcctctttactggagaaaagcattctgaagttgtctgtgtagtggcatgcaagtgatacactctgtgcaaggataacttctgcatagtgttttagagaaatacattgtttagagcacaaaatagcatcgtttgtgaaacacctggtagtcaatgcaaggtgtgctaacaattacttaatggtgaggctgcaactgatattgagagaactatttttggggggttatcatcagtataagcagcccttaacaatctttgtaacctaggggcaatcaatcatttagtttctataggggctcagattcctgatgtgtaaaatatgaagccaaggccagatcatctttaagtttcagtggttactttctaagattctataacagtttttccactatggccaagacagaatgaataaactagattttcaaaattagaatttatcttctcagcttggctttttttcctctttggtgcataacagaaaagtaaaaatgggaaataaataatatatgtgaagaggtttgggatcatcactatgtttgttggtgaattctgccactgattgcgtggggaactaagaagtgagattttcttcaccactacccgcaacattgacacaggacctaagcacataaaacaagctcgttcatatgtatagtttgggttttgacaacagcattagatgctcacagcataataatttatatgctggacatctttgggcaacttaatcttctgagcctcatttctgtaaaatgaaactaccaatgacttaagaaagcagccctgagaattaagctaaagacagaaatcctcattaaaatgccctagtaaggggagaagttgtgggcaatgctgtcaaatatccatgaaaaatgtacatttccagacaaaatggcagctcctctaatttactggtattcttcagctctaaatttcatcagtcctgttcatcagaaagaataacaagagaaacagaaggaagtactacagaaaatgagtatattttacctatcctaggtagtagaaaattttgagcattcttacatgaaaattcaacaatttgaactcattttactggcctgtataaaatagaagttgtggaacattttatttggtatttaattactttcacgtatttctggtttctttggcattgtgctttttctgttgttgttgattttactttaagttccaggatacatgtgcagaacatgtaggtttgttacataggtatacatgtgccatggtggtttgctgtacctatcaacctgtcatctaggttttttgtttgtttgttttttgagacagagtctcgctctatagcccaggctggagtgcagtggcacgatcttggctcactgcaacctctgcctcccaggttcaagccattctcctgcctcagcctcccgagtagttgggattataggcacgtggcaccacgcctggctaatttttttgtagttttagtagagacggggtttcaccgtgttagccaggatggtctagatctcctgacctcgtgatccgcccacctcggcctcccaaagtgctgaggttacagacatgagccaccacgcctggccctgtcatctaggttttaagcaccgcatgcattagctatttctcctaatgctctcccacccctgggcccaccccccgatgttcccttccttgtgtccatgtgttctcgtcgttcaactcccacttatgagtgagaacatggcattgtgctttatccacagggatcatcctatcagcatgggcttgtcaatagttagataatctttcaaagttcccattaactgtcactttttaagatgtttagttcaattctgtggaaagtgggaattaatctagtcaagcatattcttaactttcaatcactccagaaaaacattacagaatgatagaatccctaccacatgctatgataagctatacaaagggaacaattggctttttcttcttagctataatggtctagcaggaagggcccttagcattgttattttctgtgtagttgtttctcctgtagcatactgtatgtaaaagttaaacattaataccacttgggacttttacagtgcatttaatgggctcagcatgtcttagagccagtctctgagagctgcagtatcttaacagcactcctaatggcaggttactctttttctattatattaaagaccgaaggtgaagggagaaagagggtaagtggcttataaatgattatcagtacaggaactagactgaatacttgggccacattttgacagttagtccagacattcaatcacagattttggatcattgtggatgtctatgatagtaataacttcacagtaatagtcatggataatgtagagagtttaatggtacttctgcttataatgcttccagaagttctcagtacttaaaacataaggaaagttacttattgctgtcattactattacgtacaaattaacaataatgacctgcacttgggtaaaggctgtactttggactttagaattcaactattatattaatactcaactcagtactaagcagatataagatttcaataaatatttgtggattttttcaaagagcttctaaagtaaatattagctcacttgatttcacaacagctttgggagaaagattgggtgggtgtcgttatgctcattttctgtgaattggatgaagactaataaaatggacatggtcttggagtcataggaaaacttgggttcttagtctgttctgctcttaatagctgtgtgatgttgggaaattacttgacctctctgagcctcagtttgtttccgcagaaaagtagggatattaccatcaaacagttatttttaggaataaacgagattatctatgcatgtctctagctcaatgttactaatcaggatcctgcacttaataaaagacaaaaatgagataagaggtcatgttggctgactttgggccagttgccctttgcattaagtcagatttaaggcagtaatttgctagtcattgtatcatgagccatggcccaaacacttgacagactttgaagatttgttattactttgccttatggaagcctaaaaagtcatgatcataaaacaattaacatttctgctgatctggaaaaaatgtcactcgaattgagatggatgttcctttttaaattttttctgttgtgggctgagtgtggttaaggtgagttttttgagatggcactttttagatatcatttcagtttaatattctatattcctcctgtggccagaaatactcagtaactccttaactttaactctgacatattatcagtgtgtcaagatggaaaccagttgctgctgaatctctggctcaagagatcgttaagcagatgctagaaacagaagccaggcttctgagacagacgctgggcagcggatactttaagctactgaatgaacataggatggctgtgttaggtagcttggaggtagtggtgaaggaatagctttttatagtcatgactgttgaggtcacctccatccctgaaattacatgaaaatttatgagcttcctaggcttttgttcttttgatgctcagacaggcttctctactctagattgaagtctcatgcattttccactaacttagaagaacagtatggcataatggaaaaagcattggtttccgatgagctgtgtaatgttaggtagatcacttagcctctctgtgtccttttctcaatggtataatggtataatagaagttgagaagatcaatcgtgctgacgtattttgatgctttgaacatttaaagtgctagacaacactggcttgtaaaataactgattactagcagaaagagaaggtttatgctgacttatttttcaaatgctctatgactcttctacagtgtttggtagactggctctaggctcagctttgtgcctatcttaaaaaaaagtacataatgctatactgattcattcttctcattgcctaggattacattagaaaataagctccatgaaggcaaatatttttgtatgttttattcacagatgtgtctaaagtgcttatgacattatcagacatacaataggtgatcagtgaatatttgtcaaatgacaaaataatttgaagtaaggaggcacaggcatctactgttgctcaccttttgactgtgtgtgtgtgtgtgtgtgtgtgtgtgcgtgtgcgcatgcgtaggtgctgaggtgggcatgataataagtatatatcgttacatatattctatctcactttaaatggtaaagttttcatctcttgatttccagtattgggtcaggtagcatctgcttaaaggacaatttcttcctgacattttaattcaagtttcaattcaaatcccactagttctggttgcgcctggatcaacgcattagtacactcagcttaatgataccctaccaagcttcctgaaagtcttacagagatacacaattaccaaaacccacctagggggcctgcacattgaaggaatcactaatgggatttgagagggagtgctgacaacacaatcagtctttaaacgaagagtttctgttggagctaaaatccagtcagagaagcaggaggtgattttatgatttatacaaatccacaagagcatcagtaataatttgaggctaactgaaacatgcaatgtccagtttctattgagtcctggaaagacattgcctggatttatctaggcaagtagacggggtcaaatgggatccatgagcatgtcatcaataatgtttacttatctgttatttaaggaattttaatgaaaaccaaattagatgaagtgaactgtttctaatctgatttccatgcatcaagctaagctcccctctactaaacaaaagcccaggaaatctaacaaaaaccaaataagtagtgatcagtaaactgtaagaaaactgtagtctgcagggtctgtgtcaactgctattttctttggcgctcttgattctcacttgcctcaagacacagacagctgttatatccacaggagaagaagcaactgatggagtgttctctctccttaggttagaaggaataacatctcaagactggatttgtcattgaaaggtttgagtatccctttaatttcgtagaatcattttcttctccacattactaaacccagcattttgtacaagtaaatttggaattattttagcatggcttgaaatcttaaaactacagactgcacttgtatgatgctctgtcagctgcttcgaaaggaaggctctgtcaactgctattactattaaattttctctctgtttaataatttagcaaagtaacacgttcacagggtaaaaatctgagtagaatagaaagactcataatgaaacatagcagtcctcactcatcctttttctacactgagttttctggagacagtaggtttttctgccattctgttctttcctctcactgtatgattttactttttcttgatcaatcaaattctgttaattttatgctaaggaagagtttagttcatttaaactactctctcctaatatttatgcctggtatttgacttaccctattagttatcattgtactattaatacaataaactgaaacctatgtgtcgtcacgtcttatttactcaatatctcttgacttcctaccgtgtgagattaaaatattaacaccttgccttatttgctgtcctctgtccttattgccagcttctgttttccgccagttccacctttacttcaaaagagtggcttttacaattctcaccataaagaaataataagtatgtgaagtgatggatgtattacttagcctgatgtattcagtccacagtgtatatatgtattaaaacattacgttgtacctccaaaatatatacaattattatttgtcaattaaaaatgtaagaaacccaccccccccacccaaaaaccaaacaaaaagtgtcaaggttgatcacgtttacattcagttttgtaaccttgattcagttttatgtgttttactgataggtaacatccaaaaattgaaaaccaataagtgtttatagcatcattattatttaaatgcatcctgcatagattagtagtgtgctatgattactgttcttccctggcttcacaatctctcttcaaactagcatactgaaggggtcttcatatcctaaaacaacaaatagattgattttcaaatcattgtttttttaactgattaccaaattaatgcttattttagatataaaaatgtaaagaagaaacttataaagaagaatttttaaaaatcccacaacacaaaggtatgtcaaaacttcatcatgggttatttccaaatttgattttcttctccattgaaatggcaggttgaagactcagattgacccctccaatactgcaggaaagtggtgagtgttctcggtcaccacaggcataaattaatgaggccgtgtttccaaaccttgcaacccacccctttatcctagtctataatttattggaaagataaagaacatttgattgaacccataaacacccttgatgatcatattagcatttccttgagtctttctataatttcttcccctttctggttgtttgagagaaagagtgcagcccttcctttgccttgccaggaattacaaaggttatcttcttaacagattatatttgaagagtgaaagggcacacttttagtcattcacttgggacaacaggcataaactgggttgtatgatcacctgagattagctttttcttttaaagaggaaacacttccaatagaaaacagttgctcttcagcctcactcttttttaaagaagagtctgttatcccaggtggcttaatgagccaccccatacatctgctttccaccttcctgaatttacttccttgagagtcaagagcagactcttaggatgtcagcacaacagctctttctgttactcactcactcactcacttctctgcatcatccatcgttgctacctatagcttcttcctcaaggtccttccctttgtttctaacattgtgctcttctgactcttctattttgaataacctcttccatcttttgttctttttgtaattgctctactactcattctgctcccttctgactctaggcaatgtagttttgctataaaatgctttcttgctctgccttcctcttgttttggcttcctttcaggaagtacatggttcaaccctgagctctatgtagttaaccccaaatctatgtgtcaaccctgactattgttaacatgtttttctttttttagttggcacacataataactgtatatatttatgggatacagagtgatattttgatacacaaatacaatgtataaggatcacatcagggtaattagcatactcatcacctcaaacattgatcactcctttgtgttgtgaatatttaacaatttcttttctgtttttttaaagcatataataaattatcattaaccacatttaccctacagtgttatagaatgctagaacttattctttctatctaactgtaattttgtattgttacccagtctctcttcatcctcctctcctccttacatttcccagcctctaataaccacaattctattctctacttctatgagctcatatttttgtagtttccacatatgaatgagaacatgcggtttctatatgtagtttccacatatgaatgtgaacatgcggttcacatatgaatgagaatatgcggttctatgtcttgcttatttcactcaacaaaatgtcctccaggcccatccatattgccacaaatgacaggatttcattcttttttatggccgaatattgttctattgtgtacatgtcccacattttccttatctattcatttattgatgaacttttagcttgattttttatctttgctattgtgaataatgctgcaataaataccaaggtgcaggtatctctttaatatactgatttccttttctgcttctactgaacattagcagctatttttggatatccccatttggaggttcatctgactcctgagaaaaaagtggcctaaactaaatgaattctcttttcttttcttcctggaattattctagcattcgtgttacctggttcaacactcaataactattctttacaccttcctctggcactcctccttcagggaattttttagtcctgttctatttcctaatatttgatgttctttcttcttctctctatgcccactgctgctttgctttcctagttctgattctagtaaaaattctcctatgaaaagctaataaaggtataggaaaaaaactaaacaagtgtttttccatccctcacactccacccaacagaacacttctgataccagatatgtagggggttttccccacacaccaaccaagcaattctccagtagacaccagttgacatcctctactaattcaattcaattctgacactatttacctggagatagtatcagatcccacaggctgagcactcagatccataagacttctccccacttcagatgccagtcacaagcacaggctgtgacctgcttctgaccaattggctataaatcaggagttcccatgataccttccttgggtttgatcagtctgctagagtggcttacagaacttggaaacactttacttatgtttactcacttattataaaggacattacaaaggatacagatgaacagccagatggaagagctgcatagggcaaggcatgtggaaaggggcatggagcttccatgccctgtccaggcatgccaatctccaggcacctacacaagtgagctcaatgatctggaagccctctgaatcctgttcttttggttttttttaaacatttatttttattttaatttagttttatttttttgagacaaagtctcactctgtctcccaggctggagtgcagtggcgcgatcttggctcactgcaacctccacctcagccccctgagtagctgggactacaggtacacaccatcacacgcggctaatttttgtacttttagtagagatggggtttcaccatgttggccaggatggtctcaaactcctgacctcaggtgatgtgcccacctcggcctcccacagtgctgggattacaggtatgagccaccgcacctggcctcttttgggtttttatggtggcttcattatgtaggcataattgattacatcattggccattggtgatcaactctaccttcagcccctctcctcttcccagaggtctggggtggggctgaaagtcccaaccctctaatcatgaagtttttccagtgaccagcctccatcgtgaagctatctagtggctccgagccaccagccatctcatgaacatagaaaaaacactcattgctccagtgacagagctgtgtgccaggaagtgggatcaagaccaaatatatatttcatgttatcacaagatggaactctatatatgaaggtttgagagagagacacacacacataatatcatccaggtaaaggagtagacagtcttaatcattttaattaacaatctacctgcttttaaactaaagagcttctgcacaccaaaagaaactaccatcagagtgaacaggcaacctacagaatgggagaaaatttttgcaatctactcatctgacaaagggctaatatccagaatctacaatgaactcaaacaaatttacaagaaaaaagcaaccccatcaacaggtgggtgaaggatatgaacagacacttctcaaaagaagacacttatgcagccaaaagacacatgaaaaaatgctcatcatcactggccatcagagaaatgcaaatcaaaatcacaacgagataccatctcacaccagttagaacggcgatcattaaaaaatcaggaaacaacaggtgctggagaggatgtggagaaataggaacactttacactgttggtgggactgtaaactagttcaaccattgtggaagtcagtgtggcgattcctcagggatctagaactagaaataccatttgacccaaccatcccattactgggtatatacccaaaggattataaatcatgctgctataaagacacatgcgcacgtatgtttattgcggcactattcacaatagcaaagacttggaaccaacccaaacgtccaacaatgatagtctggattaagaaaatgtggcacatacacaccatggaatactatgcagccataaaaagtgatgagttcatgtcctttgtagggacatggatgaagcaggaaaccatcattctcagcaaactatcgcaaggacaaaaaaccaaacactgcatgttctcgctcataggtgggaattgaacaatgagaacacatggacacaggaaggggagcatcacacaccagggcctgttgtggcagagggggaggggggagggttagcattaggagatatacctaatgttaaatgaggagttaatgggtgcagcacaccaacatggcacatgtatacatatgtaacaaacctgcacgttgtgcacatgtaccctaaaacttaaattataataaaaaaataaaaataacaaaataaaaataacaacaacaaaaaaaactacctgctttttttctgagctcttccagaaacacagccccgcacctcctccttgctaaaatatgtacatttccccattatctacttaataaaatccaaactcctagacttgtgtttacatctatatttaaaccttatattgtactacatgtcttcatggaaatttttccagagtgtaacacacatgatttttgagtagtttttctggctttcccctcccaacttctcagctgggatagaagctgcctaaagcaggagcttgtctgccttgttcactgctgaatttcctgagctgagaatatagcctgatacatagcatgctctcaggattcattagacgaatgaataaatgaatgacgagttattgtccttactttctgctttctggccacatgccctcttagacagcacttatctgttatgagctgaattgttttttccccaaaattcatatgctgaagtcctaacacccagtatctcacagtttgactatatttggagatagggccttacagaggtgattaagttaaaaagaagtggtttgttaggatgggctttcatctaatttgactggtttcctgtaaaaaaatttgaaaaggaggaagaggaaatttgggcacacagaaagatataagatgaatgtatacacatagaggaaaggccacgtgaggaaagaccacagtgagaaggtctgcatgccaacagacaggcttcagaaggagccaactctgcaaacccttggtattggacttctaacctacaaaactgtgagaaaagaaatttctgttgtttaagtcatccagtctgtggtatttttgttatacatttacttttgcaacagtactctgttaaaccttttacatacaatcctaataagaatcctatgatgtagatatttttatgatccccattttacagataaagaaatggaagaattgagatgttaattaacttttttatggtcaaacagccagggtttggaatgtaggcaacttgattcaccctgttccctctacctggtacaccttccccttcacttctgaatggtaaattctaaccatctccaaagccagagaacatgtcttttttcactaaatttccccactttggcttcaaacttatattgtgatatttgttttactttatgtttagttccaaatttgttgtagatgcctgctcaggaatctgcttagctctccaggatgggggtctcacattattcaccatagccctttgacattaaacctagaccccttctgggatgagagtctattatgggctgaattggaacctggatcctgattgctggcggataggtatcctggctatacaaatgccaatttacatgtatttaaaaattcacttgtctcagaattccatattctattctctattacatgtataggaatctctgctagcctgatattgattacatccctggatcatcattgttcatatttccctatagcctttacatatagtgttctactctttatatgcactttccccagaatcagaagtttagtctcccctaaagcccccagcttactgtgcatagtctgtttccatggctctgcttatcctacacatgactgctgtttagcaggcaatgtccaggcatgacctgtgatagtcaatccttagatttctgttaatgattcacccatttattcacacatgcattcacttatttgttcttctgtttatccatctaactgggagctttttatatgccaggtataacacagatcaaggtcagtttcttgatttgatactaaaaacatcaacaagcttttaatgctactaacaatctacaaaaatattcctaaattaacctacactaaaatgtaatttgaaaacatatcactgatgagattcaggtatctttctgcgtgtcaccaggaagcaatctaaaataaaatcagtaacaaataagttgcaaactaggaaattataacatgtcatgaggatatgttaaatgaaggctagccgtggtgtgataagggacaactgaagtttccgaggttctggaatactgaaaaaggaatactgtggaaaaagagagattagtgctgctctggtactgcctaggagagagaaactcaatccagaactagggtgttagtgagggtgacaactgcatagaataataagtccagtttagcaaacatttttgagaaacccctaaatactagacaattgtaggatgcaaatgggaatcggatatagtccttgtcctcaagtagtggggaaaacagacacataaaatcttagctttactagaggtaggagtgaggcaagtgtggctgtcagcaatatcaagcaacacctcagatgtgctattatctgaagtgatatcagacactgtcaagatccaaattttctaggcttctctcttttctttttttttttttttttttttttttttttttttttttttttttttttttttttgagacggagtctcactttgttgcccaggctggagtgcagtggctcgatctcggctcactacaatctccgcctcccgggttcacgccattctcctgcctcagcctcccgagtagctgggactacaggcgcccgccaccacgaccggttaatttttttgtatttttagtagagacggggtttcactgtgttagccaggatggtctcaatctcctgacctcgtgatccgctcgcctcggcctcccaaagggctgggattataggcgtgagccaccgcgcctggccaggcttccctcttaatgaaaggaacatagtacaattcccagacttctgtctgatagtagaaaacaagaaagaaaaaaatggagatcaatacattttggtgggtaatatgagaactatgctggatatttaatattttcctctcccaatccatttcattcttctccactcttctccctgtatataagttatacagtctatggtattttgttacagcagtacagactaagacaccactttctgaatttaaacaaatttccgctgtgtcaaaattgagaagagcgtgcactgactagctgataaaatcaattccatttaattggaatgatatttctcactacaaaataatgaggtagtaatatgactgataactttttcacctgcacttagatttgtaaatcaactggttaacctagaacaaccaataaaattagatttctgaactctgcacagatgaagatgagacttcgaagtagaaaggaaataggaaactcaagtacctagccaacctcacctaatgctacaggaataacgcatatttagagttgctggtctcgtatggtgatacagacccaaccacagtctaattatcaggcttggagtcgagtctgctgctgcccatgaaatatggttaaaataactagtccttataggatttcaggattattagtactgtgctaagaaagggatgtccctcaggttctaaggaaacagggctctgcagaattgtaactaacttctggatgcaaccacagggttttaacatttaaagataacattggtcagtctgatctaccatccaggcagcccagttagccatgggaagaccagaagctattttcttaaatacattttctaacatagcttaaatatgatagaaatattgaaatgtggtttaattctcttggttgaaaaagaaaatgtgatctgtaaatgattctataaacttttgacttaatttctcttaatttctgcccagtgtgtcacgtatgattttgttagtaacatctgcagcacttgcaggttaacacatctatttcatccaaaatcataccaaaatgagttggatatataaaaatatttggcaaatgtcacaagtagatgcagtgaggaaaagcctaatttctaagtcacacgtgtactcaagggtgctgagttggatgagcacatattttacaaagagctggacagttctggtccttgttttatcatgggtcaggagcacaaaagtgaactaaataacagaaatcaaaaggcaaacattgacactggaagctcacaagacttagcaagaaacacattcttaaaagtcattaaacaattttgaaaagaaattcaagctgtggggattgagctctgagatcagaacaataagctccatgaattggaacagaggctttctgaaagcagttttgaagaatacttttcccagacaagcttctttgtgaggggatttttttttttttttaacaaatatgcctatttttgactcagctcagaaatgaaatatttcaaaagccttttcaagctcagtatctctaaaattactctttcaaagttacactttaaggggtactagaggattgagattaagagggataccaagtttgtaaaattttcataggcatgataaagacgcaggaaagtccccacccatccccaataatttctttagtgttttagataaaacaaacaaagaaataccagttggaaaggatggcactgttaacggggttgggaaagtgtttcaaaattcagttttgacaaaagaaagagtaagacaaaaattgctttctttctgggtttaggagttttacaaagtgaattttaatgagaaatatttttataaggtttgttttccataattaatgtcattgaatataaaaatatagcagacccttgagcaacaagggttttaactacatgggttcacttatatatggattttcttcaataaatatattgaaatatgttttgaagtttgtgacagtttgaaaaaactcacaaaccatatagcccagaaatattgaaaaaaaactaaggaaaagatatgtcataaatgcataatacatatgtagatacatctattttattatctattaccagaaaatatacacaaatctattataaatattgaaatttatcaaaagttatgctcacacttaaagactgtacatggtgctattaatagttgggagaaatgtaaacaaatgtaaagatgcagtattaaattataactgcattaaattaacagaacatactgtactactgtaataattctgtagccacctcttgtggctattgaggtgagctcaagtgttttgggtatctacttaaaatgcgatgtgacctaaccattgctgcatgagcagttcatctctccagtaaattgcatattgcagtaaaaactgatctcctgtggttcttgcatatttctcatcttgtttagtgcatcttgaataatgttatgggacccatatgaagtgccactagtgatgctggaagtgttcccaagaagcagagaaaagtcatgacattacaagaaaaagtctaattgcttgctatgtaccatagattgaaatctgtagttgtggttgctgctatttcaagataaatgaacacaacataaaaccattgttaaaaaaaaaaagaaaaggaaatttgtgaagctgttgctgcagctaggccagcgggtgtaaaaactttgtactttctgcaaaataccttttaatcttatattgaaaattcagcttttatgtggatataggattgctatgatttgagaaatttattcattatatgacaacttaaagcaaaaggaaggtgatggatctaaagctggagaatttaatgccagcaaaggatggtttgttgattttagaatgtagtatggcttaaaaaacatcaggataacaggaggagtagcttcttctgatgagttcgcagatgccattaagaaaatcattgaggagaaaggatatctgcctgaatacgtttttttttcctctttttttttttaatcatactttaacttctagggtacatgtgtacaatgtgcaggtttgttacatatgtataaatgtgccatgttggtgtgctacacccattaactcatcatttacattaggtatttttcttaatactatccctcccccctccccctctgccacaacaggccccggtgtgtgatgttccccaccctgtgtccaagtgttctcattgttcagttcccacctatgagtgagaacatgcagtgtttggttttctgtccttgcgatagtttgctcagaatgatgatttccagcttcatccatttccctgcaaaggacatgaactcacccttttttatggctgtatagtattccatggtgtatatgagccacattttcttaatccagactatcactgatggacatttgggttggttccaagtctttgctattgtgaatagtgccgcaataaacatacgtgcacatgtgtctttatagcagcgtgatttataatcctttgggtatatacccagtaatgggatggctgggtcaaatggtatttctagttctagatccctgaggaatcaccacactgacttccacaatggttgagctagtttacagtcccaccaacagtgtaaaagtattcctatttctccacatcctctccagcacctgttgtttcctgactttttaatgatcagcattctaattggtgtgagatggtatctcattatggttttgatttgcatttctctgatggccagtgatgatgagcattttttcatgtgtctgttggctgcataaatgtcttcttttgagaagtgtctgttcatatccttcgtccactttttgatggggttgtttgattttttcttgtaaatttgtttaagttctttgtagattctggatattagcccctgaataggtttttaattcagataagtgccctattctggaaaaaaatgccacaaaggacacttattagtaaggaatagaagcaagcactaggatttcaggcagaaagggataagctaatgctactgtttgtgcaaatgcagttgtgtttatgatcgggactccccttacctatacagctgctaagctcccttacctatacagctgctaagctactaggctaaaagggaaaagatcaacactagctgccagtctttcggttgtgcaacaggaaagcctggacaatgagaacacttgttctgaattggttccattaatgctttgtcactgaagtcaggaagtaccatacatgtaaggaactgttttttaaagttcttttgattttgaacaatgccgttagccacccagagtacaatgagttaaacactaaaggtgttgcagtagtctacttgtattgaagtagtctacatagtttttaggaaaacatgatgtctctaattcagcctctagatcagggggttataaggatctttaaggctgattacacacagcactctatagacaggattgtcaacaatgaggaagataatcccagtagagagaataacataaaagtctggatgcattagaccactaaaaaatgtcatcattgttatagagaaagctgtgaaggccattaaacctaaaacaacaaattcctgctggaaacaactgtgtccagataggcatgacttcacaagatttatgacaaagccaatcaaggaagtcataaaagagattatggatatggcaaaaaaggcagcaggagaaggtttcaatataggatcttggagaaattcaacagcttagtagacatctctattaaggtgtctctaattaatagaaaattaatggaagacaacttggtggagatgtgtgcttccaatcagtggcagacgatgaggaagaacaggtagaagaagcagtgccagaaaacaaatcgacattaaacaatctggtagaagggttctgattactcaagactgcttttgaattcttttaggacatgggcccttccatgatatggacattgaaactaaagcaaacagtggaagaataattggtaccatatagaaacatttttagagaaataaaaaaaacatcagacagaaattatgacatatttctgtaaagttaaactgaatgtgtctgtctctcctgcctccccttctgtctcttctacctcttccgcctctgctatccctgagacagcaacactcttcttcctcttcctcctcctcagcctactcaatgtgaagacaaggaggatgaaggccttgattctgatcactttcacttaatggatagtaaatacattttcttatgattttcttactagtgttttcttttctctagctttattgtaagaatacagtatataatgtatataacatatcaaatatgtgttaactgtttatgttattggtgtggtttctggtcaacagtaagctattagtagttacgcttctgagaagtcaagaatcatgtggatttttgactgcatgggggttggcacccctaactcctgtgttgttcaggtgtcaactgtagaaccaaaagtctggatgtatttattatttgaaccatacaacaaaaacaatagaaagacaagactctccaaataaaaattattttcaggagaaagggtatcaaactcagagttaacttacttaggtggctactaatggtcttatccatacatttggtacttgattatttaatcacagagttggttggtttgatttttataatgtgcaaaaatgcctagtgaggtagtttacattaaagtttacagactcagaaaatattttgcctagcttgattctgcatgaaaatatgaagatattcatgaagatatatatttatgtgtataaacctaaacattacaaaaatgaattaaagcaagaatttttcttgataagaagatatgtgcaaattattggttttgaataatttaatttcaaagttcaaatttaattaaaactacacactagaccaaaaacggtgtttagttttaaatacatagatttaaggcaattcaaacttgtactgttcctattttggtagagtgcttttccctgctagttaccagagaggcattgcccttgtttctctgtagcatttctccagatagatagtaacttgacaaaattactattctctccatggatggactatgcacattgcttttgcttacctagtttcctttgtttgtgcagctaccaacccaggctgaccaaacagatatacctgttaataataatattcaataagaggttttcctaacatttgataagtggatgcaggaagaaaggctttttctttgtcctggatcacatgctgtgaagaccatctagttggaatgccaacagccttcttttctagctgctgggacaaaaagccagagagaaaagcagaataaagacagagagatgcagagcgcaggacctgaccctgcctgaagccttagactttctaataagagacaatgactcttttttctgttgtaagctagtttgtgttgggtttctgtccctcacagccaaaataatcctggctaattcaacaaataagcaatagaaaaagctgaaagggaaacaatttacagcaaaatataaggcagtgcatctagctcttagccacatatggcaaaaatgagctttttatgtgttttcagatatataataaatgagaaaaataagaatttttgccttaatgtatctcaaacatagagactgttagtacattttacgaaagtgtacgacatgctttagtctgccagttaattttaaaaattgcatttctttaaatttctaaattaaaaacattatttaaaaaattgacagataattgtattttcatgtacaacatgatgtttcaaagtctatatacactgtgaaatgactaaatctagttaacacatgcattacctaacacagttatcatttttgtggtgagaacactttacatctactcttagcatttttcaagattacaataatgactttaggagaactatactggccaggagtggtggctcatgcctgtaatcctagcactttgggaggctgaggtgggtggatcacttgaggtcagtttgagaccagcctggccaacgtggcaaaaccccgtctctactaaaaaaataaaaataaaaaaaatagccaggcatggtggcacacacctgtaattccagctactagggaggctgaggaaggagaatcacttgaaccctggaggtggaggttgcagtgagccaagatcgtgtcaccgcactccagcctgtgtgatgggagcaagactctatctcaaaaaaaataaaaaataagaataaaagaagtatatttacacatcaaaaccttgatcactttagtaaaaaaaaatattgtcaatgacatatatttggttatacggaagtaaatcactgttttgataaattatttaatgacaatatgatttagccattatattagtactttctcacactgctctgaaggaatacccgagactgggtaatttaagaaggaaagaggtttaattgactcacagttcagcatggctggggaggcctcaaaaaacttacattcacggtggaaggggaacacatccttctccacatggcggcaggaaggagaagaatgagaaaccagagaagcaggaaggcccttataaaaccatcagatcttgtgagaactatcacgagaatagcatgggggaaactgcccccatgatccaattacctcccgccggtcccctcccacaacacgtggagattatgggaactaccattcaagatgagaattgggtggtgacacagccaaaccatatcagccatatatacaggtaggtttaggtaaagattaaaggtttagggaggttaatggcaaaatattcagagtaattcatctgaccttaaacgatcctccacaccctcaccacacatatgcaaaagtacatgcaaatatacttaattattgcacattacaaagcaactattactgagttaagtgcaaatttatagtcaataaatccagggaaatgaaattgtatgatgaaatttgtatgtaattgaacaggcagagtaagaaatccttatatctcagtctgtttacatgccagattgatttgattcttttgcttgttagctctgtttcatcaaagtatttacctgatctaatttcttgaattaacacatcaaataaggtgaactggtttatgagtaaacaccacctcaataactcacactatcatatcagatcactctctaatggcttcacaagtatttgtcccaactgccctttccttattccttttcctgaacctacgaataaaacctgaatgctttgactttgagttcactgctctatttagagttcagggttctcttcatgattactgccactaaacgctataaatgtagaattccacagttagaagggactctaaaatgcctatttcacttactaattctacaaatgaaaactcaagctcagggctctgacgtacccatccaaggtttcaagtggcagagctggtcctggacacacatcccagaggcccagcccaatgcttgtattgggaaggcattatgcagatgctgtgcacacaacttaggacttttcactgtattcatttggttttatgcaagtttttatgtctcagcataacatgataaatctgtgctaaatgttcaaattatctgaatgatcatattcaataattataaagttaatattgaagaaaaatagttctttatagagttttatttctgttaagtattaagagcattttatatgtattaactcatacaaatgattcttagatttttttagtagaaagtcatactaatcattctttctggtaatcctattcacttttcattaagttctcttttatataggaggtcttacgctacattttacattttgtgtagcttgtttgcttttaagttgacagatcaagtaaggtgtactggtttacaaaattggtttacacaaggtgtaactgtgttacatctcagttacatagtaaacagagtaaaatatattaaattgaataaagttttgtatgaaatcctgaatatagtctggttttatgaactattttttttttttttttttggctacatgaaagagttagaaggaagtctctgttttgcagaataaaatatctttttagaaactttgaagcaccagatctttaaggattctggataaaaatgtctgtgatgaaaagatagatgcttggggtgatgaatatcccatttaccctgatgtgattattactgatggtatgtatgtatcaaaatatctcatataccccataaatatatacacctatgtacccataaaaattaaaaataaaaaaatttaaaagatatctgtggtggaataccaaatatgcctcaaaggtagtattttattaaaatcatgaaatattcatgattttggaaattcttattttgtaaagtgagggtgatggtggttaacaacatactttttaagaaaagtatattgagtttgaacaaaatgttataataacatttgtatattttggtagctgagagtttgcctgtagagtgaatgtgcttaaatcccagttcttaaattttctagtttgtgtgaccttggcaaaaagcattcagtctttttgtatctcagttttttcatctaaaaatatgaagataataagcagtttttatctcagagttgttgggacaattaaacacatgcattaaaaagtactaagaaataataaattagtgatttttattaaaaatagaaaattattttatattattactccttaaaaatgataaataattactgctattagcctacattttgctggattttgattgaattatttgaaggagaagaaatactctttatagaaaaaagatctgtaatttacctactattaggaatttacatatataattggtttgtgaatcccgccccaacagtttctgagatttgctagatgttattcgaagcactaagctcttgccttttctcattattataatcaactatttcctgtatgccagcaaagtcagtggtaaagatgttaaatgtttacagcaagcaggaatattgtcctaatcgcataataagcaattagaaaaaaaatgccccctgacagaaagcaatcattggttatgccttatgttgagctcttctgtttcatgattgattaaatggttcttttctattaaattattgttgtgaaaacagagctgtttcatactgaaggtcatgacataacgttattcattatttaggccaatatagcaaggtttttagtaataagtcttaggaagaaagttcatttgaaagtgctttcgttgctcacattacattctgctgaggttttattaagatggagcattaaacacaatactaatgactcatgagtaaaaatatagtgaactaaatgatgcaaaaacacctcaactatttgaagaaaacatgttaaacacacatgcacatctcaaagacaaagaaaatgaaaagatcttgcttttatattgtattagagcttctaggcttctcctttcattattaatcatacttggctgcacagaacacttgcgatctgtcctttctttgtagaagctgccattgtgtgaagatggatatgccttttttctccctcttctcccacaagatgaattctcaatctcaattgctttctcatagcatgtgcacttatctttgccttttgtgcactggaggagaacatgcttctccatttctttgtctctcagaaatatgagacaagtgccttttgctctatcatgtagctgctctttacaatgtcagctgcactgatgcctgcctccagtagcaggctggtgacaaacaccacaagggtgtatctccccaacaagatgctgatcagacagcttgaaagaaagcaatgccctgtttttccattttaggggacaaacatttttctctctctccctgatttcctttctccttcctttctctctttctttctttctctctccttctcctgaaccaatttttttttctaaaaaatactaatatttgaatcaacctttcagtcaagagtattctattaacttggttccaaaccagggacaaaagtgcagaatgttcaggtaatgaggtttaggttctttactggcttaaagaggcaatgggcattctgtatctgggcatttaagtattgttccataattatttacatactgtatatataatatgtaatacatataatatgtgctatatatacagtgtgctatatatatgttctcatctatatattatcttctactttgtgtcatgtgtttatcttccctatgtcttattatttctgtattttcagaattgttcagttactacagtgtactacctataatattttgagattttttaatatacaaaaatgagcattttaaattatacttttagtgaagattccatatagctcaaagactaacagaaaatgaaattgacacaaaattaaagactcatcaatggacacttcaaaatcagacacaggtagacatagttctgttagaagaaaagataagggtagtgaagtgtctatgctttacatattctgttattccccactccctttggcataaattttaaactcattagtccagccccagatgccttgcccatctcaacacttacactatcctacaagtgtcctgtgttctagccatactaatctccttggaatttcttaaattttctaggttatcttcctgccatacttttgtacatgcagttcctctctttgcctgggtagctttcttatatataaatattcaattcagtggtccctttctctgggaagatattctcaatttcagttctcaggactgggttaggtgcctcctaaagctcatatcttagacatattcttttcattgccctttttattcactcatttattcattcattcaataaatatatattgtgtgcataatagatgccatttgtataactgtctgctgatatgcctctcatccactagactatgacctccttgagttaagagacacacagttattctcattcttctgggaattatgttctataaagtggcataaataataaactaacaaatatggaactattactcctaaaataacaagttggattcctaagaacctttggtcacaacactgtcaccaaccaaaatgtcatttgccttaggtaggttcatttgtcaatgtccttataaaacaaaccagtctcatcagcattaaaaatctgctttttggccaggcgcggtgtctcacgcctgtaatcccagcactttgggaggccaaggcaggtggatcacgaggtcaggagttccagaccagcctggccaagatggtgaaacctcatctctactaaaaatacaaaaaattagccgggcgtggtggcaggcacctgtaataccagctactcgggaggctgaggcagagaattgcttgaacccgggaggtggaggttgcagtgagccaagatcacaccactgcactccagcattggcaacagaatgagactccgtctcaaaaaacaaaaacaaaacaaaacaaaaaaaaaaaacaaaaaaaacaaaacctgcttgtcaggcttctgggcccaagcctgcacacagatgtccagatggcttgaagtatctgaagaatcacaaaagaagtgaaaatgtccggttcctgccttaactgatgacattaccttgtgaaattccttctcctggctcagaagctcccccactgagcatgttgtgacccccgcccctgcctgccagagaacaaccccctttgactataattttctattacctacccaaatcctataaaacagccccacccctatctcccttctctgactctcttttcagactcagcccacctgcacccaggtgattaaaaagctttattgctcacacaaagcctgtttggtggtctcttcacatggacgcgcgtgacatttggtgccctgacttggatcaggggacctcccttgggagatcaatcccctgtcctcctgctctttgctccgtgagaaagatccacctacgacctctggtcctcagaccaaccagcccaaggaacatctcaccaatttttaatcaggtaagtgatctctttttactctcttctccaacctctctatccctcaacctctttctcctttcaatcttggtgccacccttcaatctctcccttcttttaatttcagttcctttccttttctggtagagacagaggagatgtgttttatccgtgaacccaaaactccggcgcctgtcacatacttgggaagacagtcttcccttagtgtttaatcactgcggggatgcctgcttgattattcaccgacatttcagaggtgtctgatcaccacggggatgcctgccttgatccttcacccttagtgtcaagcaccactttcctagggggcaagcacccctcaccccttctctccgtgtctctaccctctcttttgtctgagcttgcctccttcactataggcaaccttccacccaccattcctccttcttctcccttagcctgtgttttcaagaacttaaaagctcttcaactcacacctgacctaaaacctaaatgccttactttcttctgcaatgccacttgaccccaatataaactcgacaatttttccaaatatccaaaaaacgtcactttcgatttctccatcctacaagatctaggtaattcttgttgtaaaatggacaaatggtctgaggtgcctgatgtccaggcattcttttacacatcgaaccctccctagtctctgttcccaatgtgacttgtcccaaatcctcctcctttccctcccacctgtcccctcagtctgaaccccaagcatcactgagtcttttcaatcttccttttctaccgacccatctgacttctcccctcatccctagactgatcctcctcaggtcactccccaccaggctgaatcaggctccaattcttcctcagcttctgctcctctaccctataatccttttatctcctcccctcctcacacctggtctggcttacagttttgttccacgactagcccttccctacctgcccaacaatttcatcttaaagaggtggctggagctaaaggtatactcaaggttaatgctttttttctttatccaacctctcccaaatcagttagcatttagactctttttcaccaaaaataaaaacccagcccatttcatggcttgtttggtagcaaccctgagatgctttacagccctagactctgaaaggtcagaaggccattttattctcaatatgcattttattacccaatctgctcccgacattaaataaagctccaaaaattagattccagccctcaaaccccacaaaagtactcaactaacctcaccttcaaggtgtacaataacagagaagagttgcaattactttcctcctctgtgaggcaaaacccagccgcacctccagcacacaagaacttcaaaatgcctaagccacagcggttaagcattcctacaggacctcctccatcaggatcttgcttcaagtgccagaaatctggccactgggccaaggaatgcccacagcccaggattcctcctaagccatgtcctatctgtgtgggatctcactggaaatcggactatccaactcacccggcagccactcccagagcccctggaactctggcccaaggccttctcggcttagcaactgaagactgatgctgcccaattgcctcagaagcctcctggaccatcacagatgctttgggtaattcttacagtggagggtaagtcggtccccttcttaatcaatatggaggctaccaactccacattacctttttttcaagggcctgttacacttgcctccataactgttgtaggtattgatggccaggcttctaaacctcttaaaactccccaactctggtgccaacttggacaacattcttttatgcactcctttttagttatccccacctgcccagctcccttattaggttgagacattttaactaaattatctgcttccctgactattcctaggctacagccacacctcattgctgcccttttccccagttcaaagcctccttcacatcctccccttgtatctccccaccttaatcccacaagtatgggacacctctactcctccttggggactgatcatgcaaccttaccatcccattaaaacctaatcacacttatcttgctcaacgccaatatcccatcccacagcatgctttaaaaggattaaagcccattatcactcacctgttacagcatggccttttacagcctataaactctcctgacaattctcccattttacctgtccaaaaactggacaagtcttacaggttagttcaggatctgtgccttatcaaccaaattgtttggcctatccaccctgtggtgcccaacccatacactattttgtcctcaataccttcctccacaactcactattctgttcttgacattaaagatggttttttcactattcccctgcacccctcatcccagcctgtttttgcttttacctggactgaccctgacacccattagtcccagcagcttacctgggctgtactgccgcaaggcttcagggacagtcctcattacttcagtaaagccctttctcatgatttactttctttccatccatctgcttctcacctaattaaatattttgacaaccttctactttatagcccctcctacaaatcttcccaacaggacaccctcctgctcctccaacatctgttctcagaaggatatcgtgtatccccctccaaagcccaaatttcttcctcatctgttacgtatcttggcataattcttcataaaaacaaatgtgctctccctgctaatcatgtctggctaaactccaaaaccccaaccctttctacaaaacaacaactcctttccttcctggacatggttaggtacttctgcctttaaatacatagttttaccatcctggctaaaccattatataaactcacaaaagaaaacctagctgaccccataaatcctaaattctttccccactcccctttccattccttaaaaagccctaaaaactgctcccatactagctctccctaactcatctcaactcttttcattacacacagctgaaatacagggctgtgcaatcagaattcttacacaagagctgggaccatgccctgtagcctttctgtccaaacaacttggccttactgttttagcgtagccctcatgtctgtgtgtggtggctgccactgccctaatacttttagaggccctcaaaatcacaaactatgctcaactgactctctacagttttcataacttccaaaatctgttttcttcctcacacctgatgcatatactttctgctccctggttcatttagccatactcactctttgttgagtctcccacaattaccattgttcctggtccagacttcaatccagctttccacattattctggatacgacaactgacccctgtgactgtatatctctgatccacctgacattcactccatttccccatatttccttctttccttttcctcaccctgatcacatttggtttatcagtggcagttccaccaggcctaatcaccactcaccagcaaaggcaggctatgctatagtatcttccacatctatcattgaggctaccattttgcccccctccactacctctcagcaagctgaactcattgccttagctcaggccctcactcttgcaaagggacgaggcatcaatatttatactgactcttaacatgccttccatatcctgcaccaccatgctgttatatgggcagaaagaaatttcctcactatgtaagggtcccccatcattaatgcctctttaataaaaactcttctcaaggccgctttacttccaaaggaagtgggagtcattcactgcaagggccatcaaaaggcatcagatgccatcattcagggtaacgcttatgctgataaggtagctaaaaaagcagttagagttccaacttctattcctcacggcagttgttcttctcatcagtcactcctgcctactccccgctgaaacttccacctatcaatctcttcccacagaaagcaaatggttcttggaccaaggaaaatatctccttcccacctcacaggcctattctattctgttgtcatttcataacctcttccatgtaggttacaatccgctagcccaactcttagaacctctcatttcctttccatcacggaaatctgtcctcaaggaaataacttctcagtgttctgtctgctattctactactcctcagggattgttcaggccccctctcttccctacacatcaagcttggggatttgcccctgtgaaggactggcaaattgactttactcacatgtcctgagtcagaaaactaaaatatctcttggtctgggtagacactttcactgaatgagtagaggcctttcccacagggtctgagaaggccagcacagtcatttcttcccttctgtcaaacataattccttagtttggccttcccacctctatacactccaataacagaccagccttcatccctatcttctgtctaatcatactcttattcaccattctcaactacttgtaaatgccctgcccttgtttacactgccggtttacacttttcctccaaaccaccataactgatatctcctggttttacctcaaactgccacccataagtctctcttaaagtggattaaagatcttcagtggcaaggtacacttcaatactttcaccctgatgaagtcctattctttacttttatattcactcttattctcgttcccattcttatgccaccctctacctctccccagctatctccactacactatcaatctcactcgctctcttctagctgtttctaatccttctttaacaaacaattgctggctttgcatttctctttcctccaaaatcactgaggccttgacttactgcttaaaaaaagaggactctgtattatgatgtttaaatgaagagttttgtttttgcctaaatcaatctggcctggtatatgacaacataaaaaaaaactcaaggatacagcccaaaaaactcaccaaccaaacaagtaattacgctgaacccccttgggtgctctctaataggatgtcctgggtcctcccaattcttagtcctttaatacctgtttttctccttcccttatttggactttgtgtcttccatttcatttctcaattcatataaaaccatatccaggtcatcaccaatcattctatatgacaaatgtttcttctaacaaccccacaatatcaccccttaccacaaaatcttccttcagcttaatctctcccactctaggttcccacaccacccctaatccagctcgaagcagccttgagaaacattgcccattatctctccataccaccccccacaattttcactgccccaacacttcaacactattttatttttcttattaatataagaagacaggaatgtcaggcctctgagcccaagcctgcatgtgtacatccagatggcctgaagccactgaagaatcacaaaagaagtgaaaatgcctggttcctgccttaactggtgacattaccttgtgaaattccttctcctagctcagaagctcctccactgagcaccttgtgaccaccgcccctgcctgccagaaacaaccccctttgactataatttccattaccaacccaaatcctgtaaaacggcccacctctatctcccttctctgactctctttttggactcagcccacctgcacccaggtgattaaaaagctttatcgctcacacaaagcctgtttggtggtctcttcacatggacgtgcatgacactgcttttccacataaactttttcccatagaacgtttggtgggtatttaaagcattattttctatatgtattttatttttaattgacaattggatgtctttataagacacaagtgcaatgtgatgttttgatatacatacatacattatgaaattatttaatcaagctaattaccatattcatcttccatagcctccttatctgcaaaacttgccttgtctgcaagtttaacacgtatttcccacacatactgccttttgaaatgtgcaagttagccagcacttgccaaaaaagtttaaaattttcccgcccctggatagtgtgactaaaatttttttttggcttttagccttacaacagtggtctccaatacaccttttaaatattggttatcatctcatgaaactacaaatttaaccacttttccacttttactatagcttcatcacacattacagatgttactttagcattttctggagtgtccttttgcacagattgataaatttgctcttcctttttctggatgtactatattgatgatcaattaacactgaactcatagccaatagcattataactcatgcccggatgaagcttatgtaagacaatatttttttgaaagacacattactgtcttcttgtacttaggaacactagataacacttccacactacatttatgggctattttaaacagtgaaattaccaacaaaaaacagaaaatgtaaaaaaatgtggcttcactgaacagacctcaaaaaggacacttgtttatgtgcaagagctggaacaacaaggcagagtgcaaccttgtttggcctcagctcagagcttgcttctcaagtgacttaaaatgttgtctctgtgcatatctgtgaatgacctcaaatgattgccaaaatgctaccagtattgattttggggttacaaatacattttagtaggtaaatttttaaataggaattcacaaatattgtagagtaattgtattcttctattaaataataaaagctcaataactgtttgttgacagaatgaagcttgcctgctatgctgaaagctatttctcgtattcagtgaattaaattctttattcaaactataaatctgaaaaatcatttatgctacagcgcctaaaagttaaagaaaaatcctgtttggataccatgtatattaggttctaacttacaatattcttaagtactttctccactctagagtactgctctctctgatgccaaaattcctgagctatcaacaaaataaatgtatgaaagctagacttgacactcaaacattttatcaaaaagttctgtttttagtaaagaaacaaggtcagttgaaggccatcatattgacaacatacattttctgtaaaatctgattatgacagacaaacaatttagtgcaacttactgagaggcataaatttgggttgatttttaattagcaaagactttgaattgacccatatttatcctctttcttgtttctccttaattcaagaacaagaattttcaagacgtttatagatagatgtttatataatctatgaccatggttaatagtcaagctaatgtgctaatgtggggagtcaaatctgtggtcacaatcaactaatataattcattttgagtgaacaaatatttattgagagtgttccagacctatgttaggtgttggaaataaattatgaatggaacagctatggttccataccaattaagctatcagtctacctgaacagatatatactctacaagtgacaaaagagaaaaaataatataaatacagattatgaaataaactatagaggaagaaaatctggcaatggaagagaataatggtcatagtggaggaggaaggaggcctatgttacacgaggtttgctatggtttgaatgtttgtggcccccacaatgttcatgttgaaacttaatcctctcttcataacataaaagtgcaaggtgaagcagcaagtgctgatgtacaagctacagcaaattattcagaagatctaactaagatcattgatggaagtggctacactaaacaacagagtttcaatgtagcgaaagcagccttatattggaagaagatgccttctaggactttcataggtagagaagagaagtcaatgcctgttttcaaaacttcaaaggacaggctgactctcctgttagaaagtgatgcagctaatgactttaagttgaagtcagtgctcacttaccattccaaaaattactctgcctgtgctctacaaatgcagcaaaaaagcctggattacaggatctctacagcatggtttatggaataagttaagcccactattgagatctactgctcagaaagaagattccctttgaaatgtgttcgctgacaatgcacctggacactcaagagttctgatagatgaatacaaggagtctaatgttgttttcatgcttgctgatacatcttccattcagaagcctatgggtccaggtgtattttgactttcaagtcttattatgtagaaacactttttgtagaaacaatcatcatagtgaacaggcatcgtatagaatgggagaaaatttctgcaatctgcttatctgacaaaggtataatatccagaatctaaaaggaccttaaacaaatttacaagaataaaacaaccccatcaaaaagtgggcaaaggatatgaacagacaactctcaaaagaagacatctacgcagccaacaaacatgaaaaaaagttcaacatcactgataatcagagaaatgcaaattgaaaccataatgagataccatttcatgccagtcagaatagtgattattaaaaagtcaagaaacaatagatgctggtgaggctgtggaaaaataggagtgcttttacactgctggtgggaatgtaaattagttcaaccattggggaagacagtgtggcaattcttcaaggatccagaaccagaaataccatttgacccagcaatcccattattgggtacatacccaaaggaatacaaattattctactataaagacacatctgcatgtatgtttattacagcactatttacagtaacaaagacctggaaccaacccaaatgtccatcagtgatatactggataaaggaaacgtggtacatatacaccatggaatactatgcagccattaaaaggaatgtgatcatgtcctttgcagggacatggatgaagctggaagccatcatcctcagcaaagtaacacaggaacagagaaccaaacaccacatgttctcactcataactgggagttgaacagtgagaacacatggacacagaggaacaacacacaccatggcctgtaggggagtggggggtaagggaagggaaagcattaggacaaatagctaatgcatgtggggcttaaaacctagatgacgaattgataggtgcagcaaaccaccatggcacatgtatacctatgtaacaaacctgcatgttctccacatgtatcctggaacctaaagtaaaattaaaaaaaaaaaaaggaattacattttgtaaggctataactgccataggtagtgattcctttgatggatctaggaaaagttaattgaaaactggaaaagattcaccattctagatgcattaagaacatccatggttcatgggaaaaggtcaaaatatcaacattaagaggagtttggaagaagttgattacaatccatgtggatgactttgagggttcgggacttcagtggaacacataattgcagatgtggctgaaaaagcaagagaactagaattagaaatggagcctgaagatacgactgaattgctattatctcatgatcaaacttgagtttgaggagttgcttcttataaatgagcaaagaaattggtttattgagatggactctaccagtgaagatgctatgaatattgttgaaatgatgacaaaggatttagagtatacataaacctggttgataaagcagtggcaggatttgaaacaagttctgggtttcaattaatgggttaaatgctattaaacagcattgggtactacagagaaatctttcatgacaagaagagtcaatgtgacaaactttattattatcttattgccacagccactctaaccttcagtgaccactactctggttagtcagcagtgatcaatatcaaggacagactctctaccagcaaaagattaggacttgccgaaggcttaaatggtcattagcattttttagtaataaagtatttttaaattaaggtatgtgcattttattttagacataatattcttgtgcacttaatatactatagttaagtgtaaacataacttttattgcactgagaaaccaaaaatttcatctgctcattttattgtcatactggatttattgcagtggtctggaaccaaatccacaatgtttccaaggtatgtctgtaaataacctcatccaaattcaaccacctacctacctgtatgtgaatctattcttagtcattgccttttactacatcttagattatctcttagtctgctcctgctgctacagcgaaataacatagattgggtaatttataaacaaaagaaatttattggtcagagttctagaagctgcaaagtccaagatcaaggtgccagcagattgtctgattagggcttacttcaaagatggtggaaggtgtcaggcctctgggtccaagctaagccatcatatcccctgtgacttgcacgtatacatctagatggcctgaagcaagtgaagaatcacaaaagaagtgaaagtggccagttcctgccttaactgatgaaattccaccatcgtgatttgtttctgcccccctttaactgagcgattaaccttgtgaaattccttctcctggctcagaagctcccccactgagcaccttgtgacccccgcccctgcctgcaagagagaaaccccctttgactgtaattttccactacccacccaaatcctataaaacagccccaccctgtctcccttggctgactctcttttcagactcagcccgcctgcacccacgtgaaataaacagctttattgctctttatttatatttatttatatttattgctctatatttataaaaaagcctgtttggtggtctcttcacatggacacgtatgacagaagggacaaacagacccctcaagtctcttttataggggaaggacactaatcccatccgtaatggtggagcccttgtaacctagtcaccccctaaaggtcctacttctaagtattatcacattgggtatacattccaacatataaattttgatggtacaccaacattcagactatagaccaatcttcaatgtttcttcaagaatcttcctgtatattctcttaattttcttttccaaatttacattatagacttagaaaaatgtaagaaatgttaatttgataatgctgcatatctacaactatctgatctttgacaaacctgacaaaaacaagaaatggggaaaggattccctatttaataaacggtgttgggaaaactggctagccatatgtagaaatctgaaactggatcccttccttacaccttatacaaaaattaactcaagatggattaaagacttagatgttagaccaaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaaggaactaccatcagagtgaacaggcaacctgcagaacgggagaaaaattttgcgatctactcatctgacaaagggctaatatccagaatctacaaagaactcaaacaaatttacaagaaaaaaacaaagaaccccatcaaaaagtgggcaaaggatatgaacagacacttctcaaaagaagaaatttatgcagccaaaaaacacatgaaaaaatgctcatcatcactggccatcggagaaatgcaaatcaaaaccacagtgagataccatctcacaccagttggaatggtgatcattaaaaagtcaggaaacaacaggtgcggagaggatgtggagaaaaaggaacacttgtacactgttggtgggactgtaaactagttcaaccattgtggaagtcagtgtggtgattcctcagggatctagaactagaaataccatttgacccagccatcgcattactgggtatatacccaaaggattataaaacatgctgctataaagacacatgcgcacgtatgtttattgtggcactattcacgatagcaaagacttggaaccaacccaaatgcccaacaacgatagactggattaagaaaatgtggcacatatacaccatggaatactttgcagccataaaaaagaatgagttcatgtcctttgtagggacatggatgaagctggaaaccatcattctcagcaaactattgcaagtgcaaaaaaccaaacaccgcatgttttcactcataggtgggaattgaacaatgagaacacttggacacaggaaggggaacatcacacacaggggcctgttgtggggtggggggaagggggaggcgggagggaggaaggatagcattaggagatatacctaatgttaaatgatgagttaatgggtgcagcacaccaacatggcatatgtatatatatgtaactagcctgcacattgtgcacatgtaccctaaaacttaaagtataaaaaaaaaagaaatgctaatttgaaaaagcaataaaacccaatcatgtaacaaagtcatatgaactctttaactttataaaagaaaattaaaaaaggactaaaaaaagtgcataaatactgtatacaaggagaaaagaaatattcatttaattgcacattgagaaatgtgagaagtagctctgagatgcttcagacatgtgccaagaaaagttggtggtatgtggcttcaagaaagaataacacgaaaatggcattgctttctgctcctggcgcagcttgctcacaggaccgagaggtggcattcctgggtctgggcgaggggacagcttattgcaaatgttgactggcaccaagcttgtcacagactatgggttttcattttttttcaccctctccttaaaacttagactgtagtaactgacaactcattgccattaggaagaaacttttatgagaagaaaatgacttgaatataccattggagaatattttttcagtagctttaatttcatttaaatctcaaactacaagcaaagtctaattactgatggtaggaaagtattcatttctcacattgagcacctataagatctatgttctttgacctatgggtctttagtgtgaactccaggttcatttttcttgctagtagcaggaattttcaaacacttatcttccatctgtaggtggcagtaagttattaatgtttttgttactctgcccagtggaaggaagattaaatctggtttaagagaaacaaaatataaagagaatattgttctacctttgggccagtataaagaacagtaacagtttttttttccagtggaagtttaattccttcccccattttaatttgaagtaaaattgaaatacttatgtattctcagtagactctccactagctgggatgaacttatgttcacatcagaataaacaaacctagaacaacaaggaagagtattgtataagtcagcagctgaagaaacccactgtttcttatgctgtgcatcttagcaagattagttcagatcttaaagcctactgttatatttatattaagcaatggcattttgctttcaagtatatgcatacaaaacatcaaataattattcttccaattccacaataaaaaagatttcttctgaaatcacttgctgatttccctcctgtgtttaaaagaaacaaaaaacaaccacaaacacaacaggaaaaggaactgttgatttgcaatttttctgccttgtcttttgccttgtggtagttcatatgcaaaacatgctttcttacagatggaatccactagtccttgccattaagggaaacacagcaggacccagagaggatttgctgaagctgaaaactgactttataatttagctctgagtcttgaagcagcataagtcacagtataaatcagaacactggatccaaaaatgcaaggcaaatagagcaaaacatgaatttctcccctcatactttcctcttgttagtacaattaaaacaacaaccagttcctttattgcttatgatttaacagacaagtaaagtgacaatttcaggctacagtagacagagccatagaaaaagaaaaacagccagtaagatgaggcagttactgtcatattatgccaacagatactgccaggtttctaaaataaaaacaatcttcaccatggtgaatactttgcacatttgcttagtttagcttcatggactcttcctattgcagtaaaccagtttatacttatatcgttctttgatttctcttaaaaaatttaacacaggctacagagattaagttggctatttcaaaaaataactttgggatatatgcttaacattttacctttcctgtgcttacagaatgcttttggctcaaaagggcctttctatttttgtatttatcctttatagggtagaattcttactttgtgtaagatcgataattcttactttgtgtaagatactatcgataagctttgttcctccacaagagccatgaaggcagatattctgtcctttctaatctttgtgcagctggcagaagaaaaggtcgtgtgatcccactgtgtcccaacctaagattttctgcccctgctttctcacactaataggtaacatttatacaccattgtaatttttatttttaattggtttgttttcaattttaacagaggatttcaccagtgcaaagtgcatttcatttttgatgagcagggaaaatataaccctttgacaagcacccaggtatcaaattgtccttctttctcttgtaagagtcatctggtaatgtaacaggtctgcatgaaaatgtataaaaacttattcatgagtaaagagctttttctatttcaattctaacttgcgtaaatgattttctgtggagccaaaaaatggtggctgtgtcagctgggttgatttgcctgattttcataaaaacataaacagcaccatagtttggcttttggaccttccttggtatttgtaagatctgggggaacggctcattataaccagtagttagaaagtatgagtaagtaagacccagaaaacacagcctgtaatagtaaatatcacgagtgccagtgaaaagaatcatgggcattttaccatcaaattgtcgaaagaatatgaaccgcagaattcaaacggatatgggctaaaatcccagctaagctacttatgccacctgctctgtgagcttgagcaaagtgtttaacctcagtttcattattttataacataggggttgcaatgtctatttttaaaatgtgcactaatgagataattaaagaagttatccttcatgaagcattgcaaagcacttaaaaactggtagatgcccatcaatcaacgagtggctaaagaaactgtagtatgtatgtacacaatggaatactactcagccataaaaataaatgaatgaacaacatttgcagcgacctggatgagattggagactattattctaagtgaagtagctcaggaatagaaaacaaaacatcatatgttctcatcgataggtaggaactaagctatgaggatgcaaaggcataagaatgatacaaaggactgtgaggacttgggaagagtgggagggggtgagggataaaagactacaaatatggtgcagtgtatactgctcaggtgatgagtgcaccaaaatctcacaaatcatggctgaagagcttactcatgtgaccaaataccacctgtaccctaataacttatggaaaaaaaaactggttgctgctcaaagcaatagcaacagcataagagccgtttcagtagaacatgccataggaagcagtaaagggtgaaagtatacagcagaggctaagctgactgcctgaagtttaatccctgccccttttactattgctgtgatcttgggtggatcgtttaacctctctgtaccttagcttagctatttatacaatggagataaccatagcttgaaccacatagcattgttacaaggattaactgagataatacgtatagagtaattaatacagtgtaagcaatcaatgatgttagctatttttttattattaccttccccctgcaaggggtttatctggcaataatacagtggtttccccttatctgtgggggatacaatccaggacccccagtggatgcttgagactgtagacagtactaggacttttatatatgtatatatattttccttttggtacatacttatgataaagcttaattaataaattaggtaagcaggagattaacaacaataattagcaataaaatagaacagttgcaacaatatgccagcatcactttaggtaaaataagtgtcacttgaacacgagttctttgataatgtgacagttggtctgataaccaagatgtctactgactggcggatgggttgcatatacagcatagacatgctacactaagggataattcatgtcccatggagcaggacagcagagacttcatcatgttattcaggagtgtccccaatttaaaacttattaattgtttatttttggaattttttaatttaatatgtttggactgcagttgactgccagtaactgaaaccccaaaagtgaaactgtggataattgtggactactgtgtagaagtagcctgtgtggtgttaatggacaatagaatatatttttaaaactgtggtatagccacatattaagatgtttctggaggagagagaaacagtgacttgacattggcaatgctacccaatggtaagaggaatttacttctctctgaatattctcatcaaaagcatggatgtgatcctgacacaagtgacgataagcaagtttggaaaaatttttggagttttgatcaattcaccatgtttcatttggttctgaatctcactatttaaatgaatttgtgaatattttggaaatgtagaaatccataattaatccccataagcaaaacagaggctgcttgttgaaatcagccttcacattctctctttttcaacattctgtgcagatataataaaatgtccttgcatttgtatgatgttttgcaattgaaagcattcccatacatgcagttctatgtcagcctcttacagccctggggagtaatcctagctcgtattggtatctcctccctcaaaaacaaattttgagaggtgaagtgatgtgcctcaaatcgcatagcttttaagcagcagagtaagttaaaaaaatcactcaacagtgtttgataaggttggcttttgcagcttagttttaggttatgtgagattgtactgtcacaagtaccactagaatttctgtcacattatgaattttttctgctttcactaattataataaagaaagacctttgtaacatgctttttatatttgtcttctatatttatatgtgctctttggggctattttaatttgacatttatctgctttttctaggaatattctgtgaaaaagactaagatatcagagaaattattagtgcacattattagaagagagcttcagatgaaaataaaggttggtagcttacatcataatattttcaagggcaaatacaattctttattttcgtagtcttggttatgggcttatatgtctgcatctgagagacaacaaaagaatcacagctggatttgcaagatgcatctaattgggggaaaatgcaggggtatgtgtggaaactttctttttttcttactccaaaaagtgaactcaaaaataaaagcacctgtggaattgagatttgagcaagaaaagcagtgtgggaagatggataacctttgatgtcaagttgatttctcatacctatgtggtacaatttcagtttgaatattagctatgcgatctgcagttctctgttctacaaggctcgaaaggtgaaggcagaatatttcagaggtttctcgaaactctaataaaagactctcctgccagatgacccttgataaacttcactcttcctctcagtaaaaatctcccccagacaggctcaaaagggttgatgatgttcaccactattaagtctccactcagccatgctaggcagctcagaaatttcattggaatttttccttacttggcagttttagatgttttagtcagtaatgcaaatccaaaaggagaagaacttggtaggaatatgtgaaaagtagatctatattacacaaagcgtacttgtggttatatagaagtaatatgtaatttttaaataatagcataatacatcaaaattgagcttgtggtgatgatgcacaataatatattccacttacaaatctgtttatattgttgtttttctgagtgttttcacagtgatatatttttcaatatagcatcaatatattttgtcacttatatgtcatattgtggtatcctcatcccccccttaagcttcttgagtataaggtttgtgatttattatttgcattatttttatgccttgcaaaatgactagcatagtaggctctcttttgatgtgcttgtaaaactgacctgagtatggatgtttctttgtctaaggacaatttcataatataaaatcaatacagatggtaacaccagtaaaaatcttagaaaccagatttaaagtattcctaacccggcttttatgaatttgcatttaaaaaagagcatgaggaatttttgtttatttccactgtctaaattctaagcagagagaatagcctaatggatttctgtagattagtttaaaactaacaaatagggagtaagtattctgtaaaatccctgtaattattatagaatccttcaataacctcaagcagtactattaggacttattttgttctctgagtacatatcattaggataaaaataaacacatttgaagctaaacaaagatttgaagatcaacgataaattaacttgatatatttgcagtggccaatccatgtctgtggggactggacacatcaatcagtgcaacattgagaatccctgttcttcatcccccacaggaccagtcacataatatatggggcccagttcaagatgacaatgaggagtccctaattcaaaaagcattacaacaacttttgactctctgttgtagtctctctctctcttgcaagctgttaccacgttttttatttgctgtttaatgccattcattttctcagtcatgaggacactcatggggtgagagcagaacttcacaggcaactgagaccctgtcctgagttgagcacaagtggtgtatgtacccaaccctgactctccctatctccacacccagacccccgctacgagtggagatggccatgggttattgggttggagagaaaaagcaggtagctgagaactttccctggagacatggcgaggtggtgacagtgggactaaatgtaatctgtgactccagggccctgacacctgcagaattgttctaacttacttcacttacaaaagctaaaattgaagatattatgttaagaattttcagatgaccacttcatagcattacactcctagtgaaggcccttgtgagcaaggcgtcctgtgctgctgcactggccccatgtccatgaagctggccatggttcccaagatagaagatctgtgggatgggtctggcccagtggctcacgcctgtaatcccagcactttgggaggccgaggtggccagatcactaggtcaggtgatcgagaccattctgactaacacagtgaaactctgtctctactaaaaatacaaaaaattagctgggcctggtggcgggtgcctgtagtcccagctgcttgggaggctgaggcaggagactggcatgaacccgggaggtggagcttgctgtaagtcgagatcacaccgctgcactccagcctgggggccagagcaagactccatctcaaaaaaaaaaaaaaatctgtgggatgatggagcacaccttgctgacagagaagtgatgtccttctccctagtgctgaagcaagagggttgacattgtctttctccttctccactgtgactgctttcttacttcaatgtgtactttgtcttcattttaatccacttatttttatttaaaaatgatgagaggaaggaaactggaagacaattttgataaagtataatttcataatggtaaaatcatgactcctgcaaatacaatatgaatgcatgtcaagattttatttaactcaatgattaatgaggaaaatagtaagatgccaacagtaatttaaagaacgtttgagaagcaatattaagattgctgggttggatataaaaatggttaatgtccaacaggaccataaattgtaacatttagggtactttttgttcaaaacaagttattctcatttctactggacaaaaatctacagttaacctccaaccttacaaagttgtaaagtagaacaggcaatagatagtcaagcccagcaatggagaactgcagtgtgaggacatctaagtaatctcttctgtctatttcaacttaaggatgatttacctgtcagtgtgatttgctccatcctagcattatctgggtttttatttcatctgactaacatgttaaaagattttccagtagccttctatatgcatggtaatagatgtttaatacatacaatgatagagtataaaacaggaaaataatcctcaatatatttaattcagcatgcatcctcttaatacttcaattagattatatacttctagattatagaaaatagcactggaagtagtctaagattcttaaatatttaggattagacaggtcttggtgatcttcagttttctccatgggagaagaaaatgtcattctacaatcatgcatataaatatttgtggctcacatttaggtctagaacatttttgaggctttaatttgtgtttctaagtggatgggtagactagagaaggaaataaaaaagcccagagaatttgtgagagagaaaaggggaaacaaattagtcaggtggctattcaggcacaatcccaccacataggtctaacagccagatgatgtcctacctcaagactgaactcaagtattttaggcatgattttctgccaattttgttgcatttcaattgtatttgtcataagttctattaatctcagactgaaaagacaaaatcacatatcttaaagcacatggtaagttaggtgagatatgaagaaaggattcttggtattgaaacatactaaactcaaagactttcccaattgttgctgtacagtcttccactatagaagtcttctaaaagtagaaacaaatttcacttgttgggccttgtttatatcatttgttatagaatttcttcactctatttctgagaaagagaatgttttatgtgatgttaatagttaataggtattcctggaaaaatactttatttttctcaatgaaattagtttagttacttctaagcagagttgaatgggttctttttttagaggattgcttttgaaactccaagagggagaaaggaacatgtgacattttatgaatttgtcttagagaaatttctccttacctgcctctttttccccaaggaatgcttattactatacttgaaaaatagctttgaaaattccagtctagtttaattccccctctacacaaatgatgaaagtgaggttcagaaatggttagtggcatacttaagaggaagggcaaaacacatacctcttgactgttagagtaatctaaaatgatgaagctataatttttatatgtagcctagtccttatgtgtaagtcccactgctaaaaatagttactaaatcattcagtttagagaactaatctttttttttattattatactttaagttcctggatacatgtgcagaacgtgcaggtttgttacataggtatacatgtgccatggtggtttgctgcacccatcaacccatcatctacgtcatgtatttctcttaatgctatccctcccttagcccccaaccccctgacaggccccggtgtgtgctgttcctctccctgtgttcatgtgttctcattatttaactcccacttacgagtgagaacatgtggtctttggttttctgttctgtgttagtttagagaatgatggtttccagcttcatccatgtccctgcaaaggacatgaactcatccttttttatgggtacacagtattccatggtgtatatgtgccacattttctttatccagtctatcattgatgggcatttgggttggttccaagtctttcctattgtgaatagtgctgcaataaacatacatgtgcatgtgtctttatagtagcatgatttataatcatgctactatttataatcctttgggtatatacccagtaataggattgctgggtcaaatggtatttctcattctagattcttgaggaatcgccacactgtcttccataatggttgaagtaatttacacttccaccaacagtgtaaaagcattcctatttctccacatcctctccagtatctgttgtttcctgactttttaatgatcagcattctaactggcatgagatggtatctcattgtggttttgagttgcatttctccaatgacctgttatgatgagctttttttcatatgtttgttggtcacataaatgtcttctttttgcccagaatctacaaggaacttaaacaaatttacaagaagagaactaaactttattatttgtgatgaaacaaatgcttgatttacatttcagatcctaggagagagagcattgaattaaagtctaaaaaattagaatttatcctgtctttattattagtgccgatttgaaccaatatcttaattcatttatactccattttatcatttttgaaacaaaaatttaaaactatattataaagatattttaagtagtaacatcattttaagataaattcgtatgagaacaatgcaactatgcatatcccagcacagacaacacttggtaattattaggtcaatggcagttagtggtggtagtatctggacggtacttgcttaaagccatgactgcattttactgtcagtaaccaatacccagatttattgtccagtgttttctcatgtagtttatatactctcaagtctttaccaagtgttaagttttggcttcaaatcactcaaggtttaggtaggcaggtgggaacaatttttactttatttttctagaataaaaggttaagcagttttcttaaggtacaatatctaccagcaaatgggccaggaaaaaaatgtaaggcttgtgaactttgtttactactcaaccaaaaggattggtttgttttctttctaaattaatcacttaaacttgttttttaagaatattgtaaacccaaagccaaaggattctgaatatctcacattttgttccacatttaactttgctctgttttcattttgtttgtcaagcttttcacacaattttaacagtggcatgtttaattatatgtaaaaatcatagtggttaacacaatttaccatttttacgcatttttttggtgcatgaattcaatctataagtggtcaaaaataaatgcttctatttacaaaataaacaggctttaacacatcttttcctactaaaaaaaaccattaataaatagtttttgaaggaaagcaaaacagtcaaaaaaacatattaccaggtcatatttagagtgcttgttctttgaagaaaagagtgagggagagatactattagcattctgttaagaaaggagagaaaagatagttttcagatgggatttaagccagagaagtctcttatgcccaggaagatcaatcagggtaaatgagttctccatgtattattacctaagggtagagaaaattgaagatgagattttcttccccctacttgtttgaccttgctgcataaatatgatataaaaaatatgagtggaatttgatagtggtcttttccattggtcaaaccttgaaattttaactctttgaggcttttcaaattcggtgtaaggaacacaatttcttcacatttaatcttatttgttcttattaaaatacaattgtatttgtaatcatgactttaatacaacacttatttgccgaagatctatcaataaatgctttctgccctgtgaaaacaaatgcccagcacttgttgctacactcaaggatggcagtaataaaagtggttagaaaatcaatttaaactgcatttgtactttaccatagagctggtgacacttaaacattggtaagagttacgctcttcaaatatgtgatccacttttataagcaactaaaaaccctacagcttcagtcacactctcaaagaaagaataaatgacctcacatcactccattttcagaagacctggcacttgtagaatgggggaaagaaatgagacaaaaaaaaaaaagataaacaatagaaattgtgaaacctaggctgttttaacctaagcttgcagtttatgtgtataaatggaaaaacacaatttgttctgcatgccttaatgttttacaaacttgagattatcatacacaaaataatatgtggaaaaggtttccatgtcttatttgtctttatgaatcccacgatcattacactgcttaacacaaaagaggctctacagcactcatagtataaaagaagggacagattgatggtatgaaggacacatatcctattttaatcagacagatttagatcaaaataatttctaaacatggatgttctagaaaaaaagaaaaacagaaaacaattaccagaatgttttgttgtgatgcgttactttttgtttaagtaacagtgacctaaaacaggcctgtttctccttttcttcttttctaatagcatgtgtatatttgcataagtacttttttgcttatcacaaccttttcttgttaaacattaaggacagcagagggttacagtgaagcagctggaactcctatcttctggtaatgcaaaaagtgtctggtgttcagaaaagattcaaaacttagtaataatacaaaaggagagttgtgtgttcttttaatatcataccagagcattgtctaatgggcttgcttaaggattatgtaattctctagaaggtgaacttttatttggcttactatttacagttatatgtcactcagtaacacttctgagaaatgcctcattaggcaatttcatcattgtgcaagcatcatagaatgtacttatacaaacccagatggcatagcttactatccacctaggcgatacagtatggtctattgctcctgagctataatacagatctgtacagcatgtagtaccaaagcatgttctgaatactgtaggcaattgtaacacagtggtatttgtgtatctaaacatataaaagatgtataaaaatacagtataaaagacaagaaaaatggtacacctatatagggtacttatgaaaggagcttacaggactgcaggttgccctgggtgaatcagtgagtgagtggtgaccaaatgtaaagggctaaaatactaccgtatattaccgtagactttataaataccatgcacttagtctatactaaatttacaaaaacaaaagtaattgtgctatgatgttacaatagccacaacatcaccagaaaacaggaacttttcaactccattacaatcctgtgagaccaccatcatctgttttgtctgttgttgactgaaacattgttatgaagtgcattagcactattaatactgttaattagaccaggactctgtgaagttacatgctcacttgtaggctgtggtttgatggaggcgcaaatgaatacagactggtagaaaacatcacaaaattacattttattgccctatggaacattaactagttttgtctctaaaccttgcaattttattttagcatcctttcagtgtctataaaagctcagtctcttgaattctttttgaaccaactttaccttcatgctggttgctttgtataggagctaaatgaatctttggtatgtggtttatacaattgtataaaaatcatgtttataactttttgaaaattaaactttgacactgggtttgaattatcttgccagaatcctgtcttagagaattgtagaggggagtttagattttgtggggcctgaagctcatataattttgtgatcttttataaccaaaaaaattttacagattcaaatgaaaaattatacataaaagtgattatttatttagaataggaaaataaataacagcaaattacattaatatttggagattcaggtctctttctctgaactctctttttaattgtactacagtttttgttttttttcaggagaccagagttttattattactcaagttagcctcctattgtactatagttttaaaaatggatacacaataattgtgtaaagggctaaatattattatatattactgtacatatgcagtaatctatatataatacaaattatgtataataaaaattttacatatttatggggtacatgtgatattttgatacaggcatacaatgtgtgattatcaaattagcataattggaatagccatcacttcaaacgtttataatttctttgtgtcaagaacattccaaatcttatcttttagctgttttgaaacatgcaataaattattgataactaataatttatcaataactaatatatttacccattgtgctatcaaacactagagcttacatggagatgcttcctgatcgcaacttgttttcccttcccaaaggaaattgtgagaaattattgcaattcctagcaactcccaatcccagaaagacatgtacaaggttgagggcctcttaagcttcattagcttcgaggtaagccagctctgctattgggtgaggggatgtcagcaggtaaggagctgtgaaggactgggtggaaagaaacaaaccagagaatattttccccctcaggcaaccatggagtggcccttggagcaaggctttgtgaggactcctgcatgtatctgacaagagatccaggaccgagtttgtgtgtcagggagtacaaaatcaatacagaaccataatggcaccagctcataagaaaacctttcgatatttttcagtcaaatccctcctgtcccaagccagacccaaacctggagaaactagaaaaagaagagggatagaaagaaatcaagaatgcattacattccttccccactctaaattcttgaacttgaggtttgtccaacctggcatagggctgatgaccactaaattggatatgagacagaagtttttaattggtgtagtctgaaccagatgatttaatatgtgaacatacatagaaggctctggaacctgcaggatattccagtaagggaaaataaagtggagaccaacagagtatgtacaccatcaatgacagaagaaaacattcttttgatactcacaccctagagactgattttagtgaatgaattatgtagaaaataccttaaatactcaattaattaacataataagaaagataggaaaaactatgaaatcatttatgcttctaagttcttaccgaaaacctggttagctttccccgccacctgtttctctagcaacaagggctgcccacagtgggagatgtttggaggttcactggtaaacttttatattgagaataatctaactaaatataaaatagtcttctagtgcaagggacacttaaatcctatgtacaatttcaaggatgtagactacagacagaaagtgtagcagttaagaagaagggttaaatatttgaaaatgtcattagtctaaatgtgtggtaagaaattgatctgaaataggctcttttttcctgtggtatttagaagaatagggtagactgctgagctagatttggggtaatctgggttagatacagagtaaaaactaaaagatctcagcaggtgattcctagcgacatgacattgtgaaatgacaatgaagacaagcaaaaattgtgtgagggattgcaacttactacagaacaaatggaaaagctaagacctgatatcctgtctttatgctgtgtaacagttcttactattgcaatttcaaattcaatttatgcctcctacctcattttgaagtgctaaatgagttggaaactgaaaacctcagtaatcacaaaaaaactgccttctttctacaaatgttaaaaaaagtctataaaatgagataatagggaaagatggattgaaagtaaagaataaaggaaagaaactcacctctgttcacatggggtactgagaataatgataatttctgaatgctaaacaaatacataccctgtttgaagcttgcttaatatggaaaaattattaatatgaattggggttgattttcttagtctagctcaattagttgaataacactaatttacccatttgttgccctagtgcagtggtctgcaaatgatagcccttttgccaaatcctgccagccacctattttggtaaataaagttttattggaacacaacacagtcatatccatttgtttacattttgtcagtggctgcattcctgctacaataggagagttaagttattgcaatacaaaggctgatatttgctatctggcccattacagaaaatgtttgctagcctctgccttggaacatggaggatagcactggttaatgatgaataaaagctatgagaacagctagaagcatagaaagcagattcattgagatgtgaaaattattgactttcactgcatgataaaatacatttatatgtgcttagctcctggtaaaattaagaataaatttgaaattagtgtctcaataattatttactgtaatgtcagtgatgtaagtttctagtgtcatggttgtatagggtatattcccaaacctgatgctccttttaattactgtttaacttatttaaaaacatatggctcagaaaggggaaagtgatgtaaatattatctgtttaatttactaacctttctatgcccttttggaaacagcttgttttaagtccgtagagatttggatactcagaataagccttctgtatcactttctaaactgaatttcactacatgcaatttggacttctctgaaatgaacaaccacaggggtttgaaaattctagtacagatttataacaaaatgaaaaaagattggacactgtccagaaacgtgtgatggtactcaaagcagaatgacatttgctcagtaaagctgctgaagtgttactttccttaatacttttcaacatgaaatttgtcttcttgtaagcagattacattcatagacagtgtaggaacagcactttacagcagtaaattagatcaaccaaggtacaaaaattagtgatgattttgcttacaaatatccattgtaacagtatttcattttgtgaaccctaaggtctaactctgtggcactgaaactctgttcattcactaccccactcttgtgtagagagccaatttctttaggggttatctcatactataacactattattcttcacttattggggaaaataggcatgcattttcaggaggtacagattagaatgctcaagagtgtgtgtgtgtgtgtgttgaaaaatctctctttcttaaggttctcatatactccattaggaagcattccccaacctttcaattagagtcctggcctagaacaattaaactgtgatgagaaattgttatttgcatttcaaagtaaaactttatgcatacatgctacagtattaaatcatcagtatctgtgtattttgagagaagcaagcagagaggtaaaagggctttcttcctgtctctgtaataatcactcttttattctgaacataaacagtctattactttgaaaataaagtaatataacttgtaagcctataaggaatttcatcaggccatcttgtccatcctccctgaatccagaaaggctgaatattaacacatcttattgaaattgatctgctattttgaaagctgtcttgcatccaatttcttcttttgagaaaataggaggaaagagaggggaagtttagaactctgcctagatgggctcaggagtgagatcaggtcagatggcatggactgagggaaaaaaacagagccaaaggatgagaaggactggaagagagtagaagattttggagaaatccactttatgatatggcagcagaaagaaagagaacctttggcttcggctaacaacatagataggaagtgggttaccaaaatcatgaagtcagttcagatccattttgtcagaatcagaatgaggctcactcagtagcacagggtttctctaaatttctttgttggaagactctacactgctccgtgtatgccaagtgtgaatatgcatctgttgagggagagagttggttatggtgatggccctctgtgtcctacctctttgacccatgttcttcttaatgagctgaaactgcttatggtctcattgggagtctatgttctccttcagtacattttctggttctcctttttggattactgcacaaactgctggagtgctagctgtagggttgggtattggtgggaagagcaaaagacagcattcttattctgataatctcctccgtggtcctatagctctctgttttcttgtattaaacttctgatatactacaggcatctcttcttaggatcctttcaagaattaaaaaaaaattgttgttctggaactggccaactccactgtattgcatgttgaagtacacaaagggattgcaggaatataagtcatagctgccatggagcagcatgtcctgtatgcaacggtgtaagtagtagtttacaggagctgagcaccggcaatcaaaatagaaagcatgttgttcataagatgtgaagaagtgttatacttaatgatacacaactggtacatctccatgtggctagcagtataaagggacatacagatctggaagtctttaaacagtgcatgccaaatcagttgaccttccagtagatttctctggagttgtggttgagaggttgagagatttagaaatgaggatggaaggtgagataatgtacgtgatgaagactgactgatacatttttttgtgggaaaatttaccttaagtcctgaagagctgatagagcttccacgctagaataaaaactctttgtgtgtcttgaatatacatctttgatttacaattaccttggctcttagttggctctcagacaatgtttgttggaataagtctaagagaatcaatatataaagtataaataaatctaggactgcttatatatacatcctgttaggaagattatctttattgttattttcaaatacatattaaataactgagattggaattaatgtgatgttctttaattcatgcagataagaggtttactttatttaacacatacttggcttactaaatatcagaaagttaatgtcctaaaataaaccttatccttacctatttctctgagttggtaatgttagacacttttccaggaaatgagagtgtgttagttttctattcctgaataacaatattaacaccaacttagcaccttaaaagaacatactaacagttaactcacagtttccatgagccaagtttgggcatggattcactggattttctgcataagaatctcacattgcagtaaaggtatgggataggttgggggtctcatctcaaggcttgactggggaaagggcccattttcaagctcatgtggttgttggtaaaattcaattctttgcagttgtaagaatgagggattcaatatttgctggttgtcagccaggggacaccctcaactctgcttcttgttggctggaggctgcctcagtgtcttttcatgtgggtcttccccaaactgctgtttgcttcctcaaaggcagcaaaagagataatctctttgtaatatacagcttacacttctatgtagtctaatcctggaagtgatgtctcatcaccttagtttatcagatagtctgttggttaaaagcaagtcacaggtttcacccacagtcagggagggaggatcacagaaaggcatgaacaataacaggagggggattgcagggccatagtagggtatgttcaccacatatagggagggagaaaacacaattcttgtaacttctgtaatttcatcagtaataaagcctcatggaaaatatttacttaggttgaataacacaaatatttcagacattaacacagtcagttagagaaggttttttcccgtttctatttcacttaatttgacagaattgcacgttcttctatggggtttgaaagttgccttgctaaattatttttgcattattagattttgaaaaacaattggtattagtgggtgattataaagcaaaatacttattgagtaaagccttgaggaaagtgatgatagtcaaggagataacgttcactcttagcccccagatttactctcatttagttctttaaatctgtatccattgtacttatgttgaataggtctatgttgctgttattgtaccaatgtataaatgtgtataaattcactatgtaagtcagatacttacacagtgaatcagaagccaaatttctagacactctaagaaactctgcctgacttttccactaaccatgccttttttatttttttcaaatttattactgtcattctgtgattggtaaatatatcacattgactttatcatatctgcccagtcctctgtttcttgtctttgtgattggttctttctctctttttttattttctattctagtgatcactatcagagcttgtttctgtctaccatttttaaatcctgcttttttgataaaatttctctcttttctacactgtgtatagagatgtttatttttatggagtaattattgactgcttgatagctttccccatgaaaatactgaggttaattaattaaaatatttcctgtgcaatttggtcaatttttccttgacttgaattattgtaagttgtatctgtttcagcttccattctgtcattatttgtagctccaaaataaagaattctcagatgactgaagaaaattgggaatatgttttacactgttcaaatgagactccctcagggttgattcagttaagacatttaagtggagcagaaagtaattttaattaaaatcttcttaagtttataagcatgataaatctgcttcaagaagaaaaaaggatataggattgcaaataaaaagagaaaacagatataggtaattttgtttttacctctaaccttagcaatctaagcagattcttttttggcagatgagtaaaaaacaaatataaaaattaataaatataaaaaattaataaatatatcaaaaccatcaccaatgaataatagcctctcattcatatttacaagaagctggaacacctagataaagacgtggattcatttgaaattgccaaaaccaggtctagttacctagttactgtcagagtctgagactctcttgtctcttgagctacaatatatacatttctttggacaaacaagaatttaccacatgtgtgcatcatttaggtgatgcatagaaaaacttgagaattctggacttgtcattttcgtctctcagaggacaatactgctggcttttgttgttttaagaatttggagtcatgtaacgtaggttgggaatcaggagactaatactgacctgatgcaggtgccattgttgcggcacagatgatgagcacaccaagggacgtggcagttctcaatattctttccatgtcgtgcttcatcgatgatgaagaattctttgttgtttacttgaaggtctagaatgcagcccctgaacccataaacaggacctgctttcttatgaatttgaacatttgcaggaatatggccaaggaacattgattcaaaatatgcctgtagaaaaagtaacaacaaaaaatattataggttgttgtcagattatgtggaaaagatgtaggatgtttggttctgtaattggatgtgttttaatgtgtttttctgtgtaaaagaggttgctattgttggctagttttgtcacttctactaggtggggagatagactgttttagaaaatggtccttttttacatctcttttttagctctaacaatatctaataatatttagcagaaaaatagacactcagaaaaacttgctgattgattactttgaaattttttttgagctgatgtgtttgcattttagtgtaaacattaccaaataataactaaaaaagaaaataaagccatgttaactaattgttgttaggggttgaattgtgttccctccaaattcatatattgaagttctaacccctagtacctcagaatgtgactttatttaaaaatagggtcattgcagatgtaatttattaagatgaggtcaatactggaataaggcaaaactataatccaataggacgttttggacatttataaggacttttataaggacaatagtctttttaggacttttataaagaagcttggatacagaccgactggcacacaggaatattgccatgtgaacaaaaaggcggagatcagggtgatgcatctatgggctaaggaacatcaaatattgccaacaccttaccaaaaatgagttaagaggcattatctttctcaagtcatcatatggaaagaaccctacagttctttagtttctagtttccagagctgtaagaactgtaagacatttctgtggtttaagccacccagtttgtggtactttgctatggcaaccctgacaaactaatgtaatcataatatattataaatatcctaaaatatgagcaaaatgtacggtgcttgcaaatggtgcttggaatgttgaaaatgttaccgtttcctttctcccaaatttgaacataaatatgcatgagaagtagaattttgcttgggtaatattcacttccttaattcaccttttattccaaaatcagatcaagaaaagactcttgctttgagaagacacaaagaaatcacatcatcttattgggattactggctagccatatgcagaagattgaagctggtccccttcttacaccatatacaaaaagcagcacaagatggattacttaaatgtaaaacccaaaactataaaaaccctggaagacaatctaggcaataccattctggacataggaaaaggcaaagatttcatgacaaagacaccaaaagtaattgcaacaaaagccaaaattgactagtgggatctaattaaacgtgagaacttctgcacagcaaaagaaattgtcagcagagtaaatagacaatctaaataatgggagaaaatttttgcaaactatgcatcttacaaaggtctaatatctagcatctataaggaatgtatacaaatttacaagagaaaaacaaccccatttgaaagtgggcaaaggacatgaacagacacttttcaaaagaagatatacatgcggccaaaaagcatatgaaaaaaagctcaatatcactgatcattagagaaatgcaaatcaaaaccacaatgagataccatctcacaccagtcagaagggttactattgaaaagtaaaaaaataacagacgctggctaggttgcagagaaaaaggaacacttatacactgttggtgggaatgtaaattagtttagccattgtggaaagcagtatggtgattcctcaaagagctaaaagcaaaactaccatttggcccagcaatcccattactggatatatacccaaaggaatatcagtcattctaccataaagacacacgcacctgaatgttcatttcagcactattcataatagcaaagatatggaatcaacctaaatgcccatcagtgacagactggataaagaaaatgtggtacatatacaccatggatggaataatatgcagccataaaaaagaatgagatcatggcttttgtggacacatggatggagctggaggccattatcctcagcaaactaatgaaggatcggaaaaccaaatgcagcatgattctcacttatcagtgggagctaaatgatgggagcttatgaacacaaagaaggaaacaacagacactggggtctacttgagggtaaagggtaggaggaggtaggggagcagaaaaaataactattgggtgctgggcttaattcccaggtgatgaaataatctgtacaacaaaacatcatgacatggtgtacccatgtaacaaaccttcacatgtgcccccaaacctaaaataaaagttaaaaaacaaaaaaaagaagtcagactatcttaaaggcaaccaaaccatttatagaaaattagtagaataaagagactctgtaaaattaggctgttgatctacctttatttgatcaatacaacagggccacatcttacatgggatttagttctaaagacggcaaataagatgaatatttcatagaagctaaattgtctttggaaatcctttagccaccacattggaaactaacatgctttctccagataattccaacacagctacatatttcctccagctttggaatagcttgctgttttttcagtgtagctgtagatgaagctggcatttcatgtcatgttgtataaaaactctagaaccccccagtgtgtggtgagatgtaccactgtcaaactaagagggaactgatactgagtacaataaattcacttctcacatctgatgttcattgcagagcttatgtgcattgaccagaatgatgctaaaatcagtttacatgatttaagttgctacttgatttctactttcccaccctcagcaacatatataattgaattctcataatttagatgtacataaaatgcagaccttctctgtaagaatttatgagctacaattgaagtctaaataatctggaaataagacactgctcttcagggctgttaggcatatggcaggtagatgcagcaacatttgtgtgggtaacatctctgatatcccaattcccaaaacacacattcatacctcaagttgacatctgaaaagtatttaaattggtattacagatacaataaaatggaatactgtcattgccagaattaaaaaactaaagccaaataattaagttaggggtctggtgggaggacagtgtgagagatgcccagcaatattgctttacatttatactaatacgtgctgttttcatgtggatgtacttttagagagcagaaacatgtttaattctaggaagagcaaagcatctccatgacccgtaacaggtcaaactaactctgtatttgagatattgttctttttaaaagactgagtctctgctcctaagggtgtctttaattttttttcctgagtatttcttcttatttaggtcccagagggtgattatctttgtgtatgttatggtggaagctaaaagttgcaaggtgtatcaatagagctgtcacatagcataggtgtatttctgtttgttttcacattctacaaactattagcagatctgtctattagctaagataagtgatccactgttacaagactctgcatccaaaggatgaccttcctctcactgaggatctctgacatctttgtatattgatcacacacctggaaaagtgaacctttcactgttttgacaagtgtgctctttaagcacaaaactggtagagaatggaagaataccctccttttctgtcagcagtaggaaggtatgaaggaaagtctatagagctatcaatgatttattagaccattaaaaaacacccaaacaatggaaatagatggctcctgtatttcttctgatgtgaggctcatgcttagttggagtcctgaaatgtctaaaaaagcagatgttgttggctgcacacagattaccattaaaatggtcgacttccattcccagactttcaattatccaagagacgacttttgtgtgtataattattcctaaggagacaggtctttaacataagtcttttctaataattccttgtgaatcagactatgaagaataaaatctgacatcaagatatgatggtacaagatgaaagcacagagaacagacatggacaatcaaggaggaatcatgaaaataataaaaagtatcagtgaaaactgagggaaaaggcctccatatctgacaggagtgaaacgaacactccttttcctttagagtttctctttaaaggaagaatatagttattcttttatgatacgtatgaataaaataagaaaataggcaaaggggaagtaaaatttaaaatccatcaggcaggggagagggtagataagaagctgtcctatttattttttgttttgttttaatttaaatttagatgttggagtactgcatatctttctgtaatgacatcctgatttaatgtttacttttattttgcattctcaattctgcgtctgaagttaaatgacttgtgttactaaaatatggagaggtgattataaatatacttttcggttaagatgaattatcagagcgcacttgtctttaagattatgatgacttacaattgaaacaaactggcttttatttaagagtcattaccatttttggtttttaacattatctgaattgtatggaaacaaatttaaaatcagaaacattaagttttggaataaaggtggataagaaatgttggataaagtgtttcagaaggatttattgaagtaacttttcacatgttaaaaaagcttaaattcttaaaaattgtttaagggaaataagtgaaaagggataaaaaataacaccagcaatatttatcaaaattcccattcttttgcagttaaaggatctctctctccctctctttatcttacttttccctaaagtataataatctgtgagcatatgatatcttctatgttaatatatatttttatttttaggacagagccttcaccctgattatctttggattcttggagtccatagaagtgccttgaaaatagaaagttttatacacttttttttacaaatgacatgaaatccaatcctgcttttcctcaatctcttagttgtcttttaggcctctttccccgtgttatgctgccttagaatctcgatattttgctagattcagcacatgggatgtccttacaagatcccactcagaataaatgttatattattattctaatatacccttctatattttatatatatatatggcatattgcataggacagtagctcacacaaggttatttctttaaaaatttgataaatatgagtgaagtgattattgatgttatgatcaataattcacagttaatatttgattcttaaggctttctaggctaggaaattttctcagaataatatctcctcacctttttgaagggacaactaaactttagagaagcaatcaataaactgagttgctactttgtgaacacattgatctagggaagtgtaaataaaaaagaagtatgtgggattactcttgtctataaagaaattaaatataatttggggaattaaataataaaaaaatttgttgcaaaataataacatataggtcagcaagatggcagaataggaagccccagaccctctttcccctgtggagacacagaagcaacaaaaatacatggaccaattccctttgagaggaatttagaaaacagttaagagggtcccacatgtcaggtgattgtgaagccagctgtatcaaagctgtaaggaaaatttatggcattcattcattataggtccactccccaacatagcatggcatgatgaagagaaaactcccagcttccagttttgccttgggaaaagaaatagaaaactaaaacatgtccagcatgcagactctttggggagctgtttgagtgattggattttgtcttttctgatccaggaaagggtaccacattggggatcactgagaacaaaggtgatggtttggactaatatgcaatcattcaccacagtctcttgtcctggcttggcatgggatcagagaaaattctcaccttccagtttctcactagggaggtaaagaatgagggcatgtgtccagtgttaatggctttttgggggcttctgtctcactagtttctgtctcacctgtctcagaatgctgatgggacctggcttactctcaatatctggggactgctgagaaaaaaagagttttgggaggcttacttctgcttcaaaggacccagaatacagaagacagaggctggtatagcttcatggcctctccctcaggagggagtgggtgaaagagtggatcatgcacccaatgttctggcttttcagaatgttacaagagactaatatctatcttgtttgactgagagtgttaatgggacttggcatactctagaagtctgagggcttctgagaataagagagatgggcagcttgtggcagatccagagaacctgtagtatcatatacagaaagtaaagggagcaagagattatgagctcctgaaagaagaaactggaaaatcactttaattgggagtctgcaggcacaagttcagggaagacacatccataggaaacactggagaggacctcagactgactgttaaaggtctttccctgtacaaaaagccagtccaaaaagactggaagaagtgactgtcttatcaaatgtgtggattccaccacaaagttagaaagcaaaggaagacagaggaaagcatggcataatcaaaggaacaaaatagatctccaggagacaaccctttaaaaagagatctatatgaattacctgacaaaaaattcgaagtaaccattttgaaaatgttcagtgaggagagaaaagtgatgctgaacaaagtgaaactatcaaaaaagagaaaatatgaaagaggaccaaccaaaaattttggagctgaaaactgtaatgcctgaatttaaaaattcattacagaatttcaacggcaggcttggtcaagcagaagaaagaatcataaaattcaaagacggatcacttggatgtctcaaaaggagaagagagaaagaaagaagaaaaagcttattcatagaaataatgaatgaaaactccataaatatggggaagaaaatgtacacccagaatcaagaagctgaagtactccaactgaaatgaacctaaaaaagtccactctgagacatactatagccaaaaccagagaattttaaaagatgcacaaaaaaggcaacttgtcatgtaaatgggagctcccatgagactatcagtagatttttttccacagaaaccttgcacatcagaagggaaaggggtgatatatttaaagtgctaaacattttttaaaggaacctgcaaaccaagaatactgtatttgccaaaactgtcctccaagaatgaagaagacataaagactttccccataaacaaaaactgaggaatttaatcattacatgttccttacaagaaatgctaaaggaagtttttccagttgaaatagaagaatactagacaacaacacaaaaacttctgaaagtataaagctggctaaaaatggtaggtatgtatacaaatatagaatactgtaatactgtaatcatggtgtgtaaataaattttggaatttatttattttccatttgtgctattattttattgttgtattgttatttttatggtttttattctgaaatattttctttttaaagatttcaacttattttagatacaaggggtacatgtgcaggtttgttacctgggtatattgcatgctaactttaggaatttagaaattaagggcaaaagtataaaataactataattataaaatatgttaacatgtacacaatataaaatgaggttatttttatgattaataacataaagtgtgtgtgtgggagcaataaaggaatagagttttagtatgtgatattgaagttattattaccttaaaatgtaaatgtactgctatagctataaaatatgttgtgtaagcttcatggtaaccataaaaaatacctatagaagatacaaaaaaacaaaaaatgaaatcaagttatgtcattaaaaagtcacaaaggaagaaagcaagaaaggaaatgagttacaagaaaacttggcctacaagagattcactttagatttaaggatacacacaatgagaaagtgaaagtatggaaaaatatattccatgatcatattgttgggctttgtgtccccacccaaaatctcatcttaaattgtaatcccctaaatccccataatccccacatgtcaagggaaagaccagatcaaggtaatttcatcatggggatagttttcccatgctgttcttgtgaaagcggcagttcgcttgagatctgatggttttataagtgtttggttcttcctgcgttcattctccttcctgccttacaaggccgcaggaaggagaatgtaataataattacattaacaaactggaagataacaatcacaggatcatctcaataaacgcaaaatgtcattttacaaaatttgaactctttcatgaaaaaatactcagcaaattaggattaggaggaaattaattcaacagaatacatatcatactcaatggtgaacacctaaagcttttccttcaagttgaggaacaagataaggatgcccactcactgcttttattgagcatagtactggaagtcctggctggagcagttaggcaaaagaaaaaaaaaaggaacaaaatgcatccaaataagaaataaagaagtaaaattattttttgttcacagatgacctgataatatacatagaaaaccttaatgatatctctgacatacatgcacacacacaaaaactgttagagccaacaaatttagcaaaatttcaggatacaaaaatcagcaaaaattaattacatttctatagactaaccattaactatcacaaataagaaaacaattttatctataatacatgaaaaaggataaaatagcataagaataaacttaagagggcaaaaaacatgtaacttaaaactacaaaacattcttgaaagagaaaaaaggcacaaataaataagaaaaacactttacattcatggaacatcaataaaatgtccatactatccaaagtaatctacagattcaatacaatccataccaaaattccaaagatatttttacaaaaattgaaaaaacaatgctggaatttatatggcaccaaaggatgccaaatagccaaaacattcttgagaaagaatacaaaatgggagaggttcccacttcctgacttcacagtatattacagagctatagtaatcaaaagtgtatggtgctggcataaagaaatgtataaaccaatgaaacataagaggctgtgaaaaatcccatggacacatggtcaaatgatctttgaaaagggtaccacaaatgcatgtggaaaataatcttcaacaaatggtcttcggaaaactggctattcacatgcaaaagagtgtcattttataatgagcaagcatttggcatatatctgaaagatgtcttgaggtagtagaaaattcagaacttagctgaggtacagtcactgaagatgtcgttaaatgtaaaatattctattctcaacaagtatgccacactgctttaatttacactatataattacacggcattaaaattctgatacatcagtctagtggcaagccttaagtaggaacagataaatatgttcaatctgcttatgcaacaattactctaatgggagtaggaaatagtgcatgttcccaaggattctcattattttaagaatgtcccaggaattccctgttagtcacaagtcaattctcttccactagtaactgagagacgagagaccctgaaaggccttgaattcctttttcactaaggctgttcctgatgggagagcttcagcaacatcttggatagcaaaccttctactgaccattatattgactataataacaaaagaatgaagacaaattcacattctaaggaagactccagaccactttccacaatattttccacacagtaggaaactattttcaagaaggtaacccctactcatcatcaagaatcaatttgttcagctctatgataatattttcaatgaatcagtaagacaatcaataatatgttttcttttgtttcttctgaaatccctttattgtataagaaattaatggtataatttaaaaagcaaggattttgaaaattgaaaaaattaaattggatctttgtcttacactatacataaaaatctacttaaagttgattaaagacttaaacttaacacccaaaccataaaacccctagaggaaaacatggggaaaatgcttcattagttttgacaatgatttcttggttatgacaccaaaagcacaggcaacaaaagcaaaaatagacaagtgggacctatgtcaaaaaaagcttctgtgcagcaaagaaaacaattaacagagtgaaaaggaaacctacagaatgggagaaaatattttcaaaccatatgtttgataaggagttaatatccaaaacatataaggaatttctacaactcaatagcaatgaacaaacacacaaagcagacaaacaaaaccccagtataacctgattaaaaaataggcaaaagacttgaatagacatttttccaaataagacatacaaatggccaacaggtatgtgaaaagatgctcaccatctccaatcatcagggaaatgcaaatcaaaaccacaatgagatatcactttataattgttaagatggctattacccaaaccagaaaataacaagtcttagtgaggaggtggagaagtggaaatttatgagcacggttggtcaggatgtaagatgatgtagccactgtagaaaacagtatgggggtttctcaaaaaattaaaaatagaactaccatctgatctagcaataccacttctgggtatttatccaaaagaactggaaataggataaataggatatagaagagattatttgcagttggatgttcattgtagcattatttgcattattcacatcattcaaaagatagaaacaacataaatgtccattaatggatgaatggataaagaaaatgtggtatagtatgatctcacttatatgtagaatctaaaaatgttgaactcatagaaatagaaagtacaatggtgattgcagaggctggtcagggatggggatagacagaaaaaagaaaaacattggtcaaagggtacaaagttccaatctgataagaggaataaattttggtgatctattgcacagcatggtgactatagttaataataacatatttaaaaacaactaaatgagaggattttcaatttcttaccacaaagaaatgataaatatttgaggtaatggatatgctaatttgctgaatttgatcattccacaaagtatacatgtatcaaaacactacattgtacctgataaatatatactattattacctgtcaattaaatatataataaaaaaggaaaacgatatatgtgtagatattatggaatattcaattttttaaaagaaagaaatctttcatatggtacaacatagatgaaccttgaggactttatgataaatgaaataagccagccacagagtacaaatactgtatgattccacttaaataaggtatagaaagtaaactcatagaagcagaaagtagtcagaggttgcggggagagagaaatgaaaagttgctcttcaatgactatagagtttcagataagaagaaaaagttctagagatctgttccataataatgtgtatataattaacagtaattagcaataatgtgtatataattaactgtacacataaaattttgttgcttagtaatagttgcaatagaataaaggaaaacatcataaatcacgttcagcacatgtatcccagaacttaaagtaaaaaaacaaaacaaaacaataaatcagattagaaataaaaaaaagaaaacatcatataaaatgttgtgagaccacatagttttggttaaaagcatggactatctagctagaatgtctgggtttgaatccccaaatagctgtgtgatcttgggcaggaaactcatcctcgtgctttattttccttctctgtatttgaagataataatagtatttacttcatattttttggtaacaattaaataatttaaaatatgaaaagtgcttagaacagtgtctggaacatagtattacatattttagctattatcagaattaagaataaatttttactttttactttcaaaattaccagaaaaacctccaaattaatacaggtgttttttcttatccaacctagaatatcacatttgagatttaacccctttggtgtcaatctggctttgttttgggtttatgtactgaaaaatactattttgtacataatgattctttgaatatacttaacaatccctactaaattataatgagtagaggcagtgctagaacctattttgatattttgtgccaaagtccgtgactcttaaaattaaatagcttcagctcacaaaattttcagttcttatatctttattccacaaacctccatcatcctcctactgtaataatagaggaaaaggcagtagaaaacatgcagtagaaaagccacttaggtgctctttctcagacaagatcctgccagaacttggagagaaagggcatgtgccatagaggttgggccctgaaggctgtaatataccgtaactctgggactgaagtgtgtctgagagaatctcaccacatatagcctccacaagcgtgaccaaattgagctttggggttaacacaagttagaaggtagcagtgattcacccaggcttaggagcacttgaattgggctgaacttaaggaggcagagttataaaagcatgtgacagctcctgtagcggcagcagggaacagccaccgaggctttagagtgcctacatgcattctctctttaccaccctaaaattatccagattattttccattgaaataataaattctactcccctgtgtgtgcatgtgcaacttgcagcattctgatcggtatttcatttcgtcagcctaaagggcaaggtaactggtttgtcaaagaggctataaatatgtcatatttaacattttcaacaacaaaaagatatttattgagcacttactggattctatgtgttaaaaatgtgattcattaatgtagaagttggtagcatattttatgctattcataagaaaatacagatctttcaatataaaaaatgggcaactataaggagttaataaagatgtagtcatactgaatgctttacatttttcactatgagtcattcatatattttctactgcttgaatattccatgtcttaaatctaaataagtggccctctcgggatctagaatgactttttaaaacataaaaacaattttattcctaccctaacaacccacttgaacaattttgagttggctgcagtagcaaatgaagatcagtacagtgcattataaagggacacaaaagtgctgggaaacagagcctgagatagagcctcctttcttatcactataaaattctggtcaaataagatactcagcatccttcagctgtagaaaagagataatcattctaccttttcagggttcttgcagatattgaatgagataatatttaaggccataatttggaaaatacaatgtgcttatacaaatgttagatgttattatgtgcttcttttggatgcctatatatactcaagagactatatagaagaaatgaaaataaaatgaaatttccaattcattaaggcagtgcatagtggctgctttaatgtctactaaaattagatctctaattatacagattaattctccatgatgatcaaatgaactaggaatttttatcatgaatgtattgcaataaagttatactaagaaaaatgtaaccaaccacatcattaaaacagaaagaattcagcaaattgcctggtctctggagggatagacattctcttttcttttaatttagactcattcaatgtttctaagagaaattttctggccaatgcaaatctggaagactgggaacggccttttttaacagtgcaagtactatcatatcctataaaaacacaagtttttaaaaaattgtcatattttgccaatctttccccactctggagctgtcttttttttttttttttaaagtcaagcacaatgtattaaatccaaagtgtgaaaggaaaatcagtttattgttaaatttgataaaactttgatagtgacaggcaacattaaatatatttaatcatccctaaagcatgagttgaattttctggtgctttgttgagagtttttacaaggaatctgttcaattaagaaatatgattactgcttagtaacataaaaaatacttatctgaaatactgagggcacaattagtgtttggaactggatatttgcatacctacctgagaggcatgggaaatctctgtgtctttcttctgtactggaggttttccatctgcagtcatttcaatcatacaaacaactccagggctgccaacaggcgttgtgtagctaaacgtaaaacagaagaggccattatgatatgtgtttttggcaagaaaggagtaacttcacacatggatagtaagtacttcttcattgagagaggtactttctggatcacaacaatcctgaaatatggacccagccaagtgtggacattttcaagtagataaaagatgtatttcttttctaacactgcgttttattttccttctctcctactgactttaaaattggacatggaatgctttcagaaagttaaacctcccacaaaataaaaagagcttcatgtgtataagtagatattgacaaattttaagtgctaactgtggttgacatatggtctccctcatgtaggagattgttggaccagtaacatcaatgttaaatgatgctaaactccctaggtagaatttcccctccctggcctacagggaaattgaaatggaataagaaatgaaaggctgcatacccctgagcagagagattacactgtgatacagttatcagaactcagaaagcatgccgctaatgtatcggctggtactgtatctcagagataaaagcataaggttaagggagtttgtagaatgaatagcaaaaatggtgaatacacaactgaaaatttatcagagtttatagaatgatgcaatcatatgaaaaggtacatatactaaggtacttggcatattttttaagcagcttatttagagttttaaagaaaattcaaacaatattaccctggcacctgccatattgtatcaacagtaacttgcactgttataaagtttatttcgtagggacaatacaaatatgttcgctgatattaacagtggctgtttctgcatactgagagtgtgggtgatttcatttctcatttttgcttatttgtattttttaaattttggacaacgatcagacttattttttattttttatttcgatcagaccttcttgtttgcctgggactgaggagtttcccaagacatgggacttttttttttttttttttttttttttttttttttttttttttagacagagtctcgctctgtcgcccaggctggagtgcagtggcgcgatctcggctcacggcaagctctgcctcccgggttcatgccattctcctgtctcagcctcccgagtagctgggactacaggcgcccgccaccacgccaggctaatttttttttgtatttttagtagagatggaaaccagtgtgagccaggatggtctcgatctcctgacctcgtgatccatcccccctcccaacctcggcctcccaaagtgctaggattacaggcgtgagccaccgagcccggcaggacttttagttttaaaaccagagaagttcctggaagacctggagaagttggtcattttatttttaaaacaaaaagtcaattttattaaacaattattggttaaataacttagtaatattttttcttaaaataactttgttgacttagttgaatgaaaaaacaaaaaacaaaccctaagcttcctctttcccttacccctcttaaaggcgcaactgtgggctggttccttctccttgcctactaggtaataagaatctgatatgatccttccagtaaattattccacggctgttttggcttccactttagcttaccaaggtcatttctaattctgatcaggtcactgttaaaaattcttgaattctggccaggcgcggtggctcaggcctgtaatgccagcactttgggaggccacccttaggtgctctttctcagacaagatcctgccaaattgtgtcataagaaacaaaaaaaactctataaacaaatgagatattatgtcacataaatcatttgaggaaaagcctaagagcatatcccttatgcctctcaagtattgctgaggccagcctagtctaatgatttaaagacttaaggatcatattctgagataatccgttgactggctgagtgatcttaggcaaaccacttaacctttcttccctgaagtgtgattatgtacagaagggagataatcattctaagctcataaatggttagtgagaatcacattatttaatgtacataaatcattcagtgctaatattaaaatccaagttaaagcaattatttgctgactagacagggatctctaaggagatttttgtaaaaataaattacacagtcaagttgaattgttcatccacttctactaatattgctcataatggaattcaaaatcaaatactcaagttgcgttattttaaaaactgaaactcaatgcaaccgactttttttttcagtgtccttaacatttttgcactttagatttataatttttaggtatgcttagcaatattggtggaaacattctgatttggaaaagacaatttatttgtagatttttagaagacctgcccaaatggaagttcaggttatctaaaacaaatgaaaaggctgcaaaaaggtaaaaaaagaagagttcattgcttaattaattaaatcaagtaatttaaataattcatccagctcttaaacaagagttatagaataatagtaacacagaaagatatttgcgtgaaatagaaaaagggatacatgtaatttacattacataatataattttaataaaaatatgcataggataataccagagctacttttactaatatcaacagtggctatctctgtatcctggtgatatgggaggcaggcagggaagtgctgggtagagaagggcagggtccctggcaagggctccaccctttggcctgtgcctgagaaactaaatgagaataggcactcatgttttcatgcacaaatgttgcattttccaagaccactctggctcaccatgtcccctatcctatgcccatataaacctgagacattagcaggcacacacagaatcagctgattgtcgacaccagcagactagcagaccagccacggtggaacaatgtagcagagaaagagagaataggagggatgtctggatgccaaggggagtttggctgggggctgtcagagaagagtccagcccctgggtggcccaactccaggggaagaccatcttcccactccatcccctctttcagctcccatccgtcttgctgagagccacctccaccactcaataaaaccttgcactcttcctttgagcctgtgtatgatctgattcttctgggacactgggcaagagctcaggatacagaaggctgtcacactggccccctgcccttgcagtaaagcagagggcccactgagctgattaacacacaagccatccacagatagcaaagctaaaggagcacactgtaacacatgcccacttgggtttcgggagtcacagactcccacccctagatgctaccgcagggccaagagcccaaagcactcaccctagcctctgtacctgcccatctgcatgctacttctaggggtttgagctgcagggtgaccaaacaggggaggcacatccctgtcacatgtcctgtgaggggaatctgggaactttcctgcttcagtgggaatgaagatgattttgtgtgtgtgtatatagagatagggtcccactatgttgcccaggcgggtcttgaactcctgggcttaagtgatcctcctgcctttccctcccaaagagctgggattataggcatgagcctctgcgcctggcctgaggatgatttttaaattgtgtcttttgcttatttgtattttctaaattttggacactgaacatatgttttttaatcttatctcttaagacaaaaattcagctttcattaaaaaacaagaattaaagaattttccaatatttttctgttgtttcctggattccatgccttcctttcaggttcacctatatacataatagccaagatttggaagtaacctaagtgttcatcaatagatgaatggataaagaaaatgtggtagatatacacaatggagtactgttcagccataaaatagaatgagatcctgtcatttgcaacaacatggatggaactggaggtcattatgttaagtaaaataaaccaggcatagaaagacaaactttctcacttgtttgtgggagctaaaatttaaaacaactgaactcatgaagatagatagaatggttaccagaggctgagaagtgtagtaggggtctggggggttggaacgattgttactgggtacaaaaatatagttagaatgaataagatctactatttgatagcacaatagggtgactatagtcaataacaacttaattgtatgctttaaaataaataatatgattggattaatttgtaacacaaaggatacatgcttatgttgatggataccccatttaaactgatgtgatttacacattgtgtatctgtgtcaaaacatcccatataccccataaatatagacatccactatggacccacaaaacttaaaaattaaaaaaaaattcctcaaactttggaaaatttttacctgaatcatcttgaatattgctttttggtattctctgaatgatatggtttggctgtgtttccacacaaatcccatcttgaattgtagttcccataatccccacatgtcatgggaggaacccagtaggaggtaattgaatcatggaggtggttacctccatgctgttcttgtgatagtgagtcagttctcatgagatctgatagtttataaagggcttttccccctctttgctcttcacttctccttcctgccatcacatgaagaaggacatgtttgcttccccttctgccataattgtaaatttcctgaggcctccccagccatgccgaactgtgagtcaattaaacctctttcctctataaattagacagtctgggacagtcctttatagcagcatgagaatggactaatacacagaacactgaaatctctacttgtagaacttatgttagacattttttggaagcctgttaagcagtcctctaaatttcttaatctcgcttttactcttaaaaaaatcttcccttatttttttctgtctgacattcttcttaggtatcatttttttcttcaactgtttttagactagagtttatcctatctactgagttttaaatgtctatgaatttttttattctcaaggttttgaatatatttcttttttgtgttttatttctgcctgttatgcttttataacttttccccatattttaactaatattttaatatactttcttataaaatgttatttttattggaaaatattggaattcagtttccactctttaaataaggagcaataagtattatcaaagtttgaatcactttttttttttaacttttattttaggttcaggggtacctgttgcagtttgttatataagtaaattgtgtgtcatgatgtatagattatttcatcacccaggtagtaagcatagtactgttaggtagtctttttgactgtcatcatcctcccaccctccaccctcaagtaggctccagtgtccgttgttgccttctttgtgttccctttgagctaagcacttaatatttacctcccacttgtaaacgagattgtgtggtatttggttttctgatcctgcattagttcacttaggataatggcctccaactccatccattttgctgcaaaagacatgatctccttttttatggttgtgtagtattccatggtatctatttaccacattttctttatccagtctaccactgatatgcatttaggttgattccatgcctttcctattgtgaatagtgctgtgatgaacatatgggtgcatatgtctttttggcagaacaatctatatgcctttggggatgtatccaataatgcgattactgggtcgaatggtaattctgttttaagttctttgggaaattgccaaacttctttccacaatggctgaactaacttacattccctgcagcagtgtataagagttcctgtttctccacaaccttgccagcatctgtaattttttgactttttaataatagccattctgactagtgtgagatggtatctccttgtggttttgatttgcatttctataataattagtgatgttgaactttgttttatatgctttcggccacaagtatgtcttcttttgaaaagtgtctgttaagttctgttaagttctttgcccactttttagtgaggttttttgttttttgcttgttaacttaagttccttactgaatctgtatattagatctttgtcagatgcatagtttgaaatattttcttctatcttacaggttgtctgtttactctgttgctagtttcctttgctttgcagaagctctttagtttaattaggtcttatttgtcaagttttgtttcggatgctattgcttttggtgtctttgtcatgaaatctttgccagggcctatatttagaatggtatttcctacattatcttccagagtttttatagttttgggttttacatttaagtctttaatccatcgtgagttgacttttatacatagtgtaagaaagggctgtagtttcaatcttctgcatatggctagccaggtatccctgcaccatttattgaatagggagtcctttcccattgctttttttgttaactttattgaagatcagatagttgtaggtgtatggcattacttctgggctctctattctgttccattggtctttgtgtctgtttttttgtacaagtaccatgctgttttggttactctaggcttgtagtatagtttgaagttgggtaacataaaacttccagctttgcactttttgctttggattgccgtggttatcctggctctttatcggttccatatgaattttaaaatagttttttctaattctgtgaagaatgtcatttgtagtttgatagaaatagaattgaatctgtaaattgctttgggcagtatggccatattagcaatattgattcttcttaatcatgagcattggtatgatttaccatttgtttgggtcatctccaattcctttcagcagtgtttgtaattctccttgtagggatcttttacctcactggttagctgtattcttagatattactctctctgtgggtcttgtgaataggattgcattattgatttggctttcagcttggatgtttttggtgtatagaaatgctactgatttttttatgtggattttttttatcctgaaactgctgaaattgtttatcagttctagaagcagagactcctaggagcagatattttgggcagagactatggtgtgttctaggtatagaatcaattgtctgcagagagagagagtttgacttcctcttttcttacttggatgacttttatttcttactcttgcctgattgctctggctaagacttccagtactatgttggatgaaagtggtaagagtggacatccttttcttgttctagttctcaaggggaatgcttccatctggtgcctattcagtatgatgttggctgtggatttgttatcaatggctcttattattttgaagtatgtttcttcaatgcctaaatgcctagtttattgagggtttttgacatgaaatgatgttgaattttatcgaaagccttttctgcatctattgagataatcacgtggtttttgtctttagttctatatgataaatcccatttattgatttgcatatgtttatgcaaatatttcatcccaaggatagagcctacttggtcatggtggataagctttgtgatgtgctgctggatttggtttgcccatattttgctgagaatttttgcattgatgttcatcgaagatattggcctgaagttttctgtttttgttgctgtgtctctgctgggttttgatatcaggatgatgcttaactcatagaatgaattaaggaggagtccctcatcctcaactttttggaatagtttcagtaggaacagtaccagctcttatttatatttctgatataatttgtctgtgaatctatttagtactgggctatttctggttgttaggctttctattactgattcaactttgaaacacattattggtctgttcaaggattcaattttttcttggtccaatcttgtgagatatgtgtatccaggaatttattcatttcttctaggttttctagtttgtgtgcatagtggtgtttgaagtagtctctgaggttttttgtttttctgtggggttggtggtaatgtcccctttgttatctctgattgtgtttgagtctttttttttttaatttcaattagcctacctagcagtctgtcaatcttatttattcttttaaaaaagaaacacataggttttttgatcttttgtgtgtttttttacatctcaatttccttcagttcagttctgattttgattatttcttgtcttctgctagctttgtggttggtttgctcttatttctccagttcctctagatgtggtgttaagttgttaatttgagatctaactttttgatatgggcatttagcactataactttccctcttatcactgctttagctgtgccccaggaattcttgtatgttgtatctttattcatattattttcaaagaatttattgatttctgccttaatttcattgtttacccaaaagtcattcaggatcaggttgtttaatttccatgtgattgtatgattttcatcatttttcttagcattgatttctatttttattgcactgtggtctaatagtacggttggtatggttttggttgtttaaatttgctgaggattgttttatggccaattttgtcatttattttagagcaggcacaacacacagatgagaagaatgcatattctgttgtttttgagtggagatatctgttaggtccatttggtcaagtgtcaaattcaggtcctgaatatctttgtcagttttctgcttcagtgatctgtctaatactctcagtggggtgtttaaatctcccactattgttgtatggttatctaaaattcttcataggtctctaagaacttgcttgatgaatctgggtcctgtgataggtgcatatatatttagaatgattaggtctttttttcgaattgaaccctttaccattatgtaataagtttatttatcttttttgatcattattggcttgaagtctgttttgtctgaaattagaatagctacccctgctgttttccattttctgtttgcttagtagatttttccctctctcttgactttaagcttatgggtgtccttgcatatgaggtggttctcttgaatatttgaatcttgtttctttatccaacttgctactgtatgccctttaattgaggcatttagcctgtttacattcaagattaattttgacatgtgcagatttgatcctgtcatcatgttgttagttgattatcatgcagacttgattgtgtggttgctttatggtgtcaatggtctatgtgcttaattgtgtttttgtagtggctagtagtagtctttcctttccatatttagcacttccttaaggatttcttgcaatgcatgtctggtggtaatgaattctcttagcatttgcttgtctgaaaaggatcttatttcttctttgcttttaaacttagtttaactgagtgtgaaattcatggttggaagttattttctttaagaatggtgaatataggcccccaatctcttcttgcttttagggtttctgctgaaaggtctgctgttagcctgatggggttccctttgtaggtgacctgccccttctctctagctgcctttaacacacttttaatgtatttcaaccttggagaatctgacgactatgtgttttgagcatggtcatcttgtatagtatctaacaggtgttctctgcatttcctgaatttgaatgttggcctctctagtgaggttgaggaaattttcatgaatgataccctgaaatgttttccatgttgcttgctttctctcctgctctttcagggatgccaatgagttgtagatttggtctttacctaatctcatttcttggaggtttattcatttattcattttttattcatttttctttatttttgtctgactgagttattttgaagaactggtcttcgagctctgagattctttcctccgcttggtcaattctgctgttaatttgtgttaggaaattctcgatttttttttttttttggagacggagtctcactctgtcacccaggctggagtgcagtggcgtgatctcggctcactgcaagctccgccccccaggttcatgccattctcctgcctcagcctcccgagtagttgggactacaggcacccaccaccacgcaaggctaatttttttgtattttcagtagagatggggtttcaccgggttagccaggatggtctcaatctcttgacctcgtgatctgcccacctcggcctccgaaagtgctgggattacaagcgcgagccacttctcccggccagcttggttctttcttaaaatgaccatttcatctttcatctcctgtatctttttattgtactccttagattctttagattttttgactttgttctgaatcttgatgatctttgttcctatccgtattctgaattcaattttgtcatttcagccatttaggcctgattaagtaccattgctggaaaaccagttcagtttttggaggtaaaaaggcactctggttttttgagttgccagagttcttgcgcttgttctttctcatctatatgggttgatattctttcagtctttgaagttgctatcctttggatgtgtttttggtttgtttgtttgtttttgcttttatcttctttgatttccttgggggtttgattgtggtacaaagtgggttcagttaactggcttcatttctggaaggttttagggggccagtgctcagctcagcactcctgggctgtgtgctctaactctggggggtggggctggtaccagactcctggctttttctctctggccccttgaggttatgaacctgctgtgctggcagggctgagatatttccagtccgctggccagaacgctccggtgaaggggagctggccaaagcactgcgtcggggtggcagcagcaggatctgtgctcagttgcacatgcctgcaccgtggcagagtactggcgagactggggatgcggtgctcctgctctgacagtggtggtggtgtggcaggggcagggtgttggcaggtgcagggcttccagcctccatgtgtgcatttgcactggtggcattggctgtgtgtgtgtttggttgggggggggggtggtggtgtggagagaagggggacagggctgtggcctgtaatttctctttttaaatagtaaaattattccttcatttatgctttctagtgttttaaaaatactttagagttttttcaggccctttcataaaaattgtcttatctagaatgattcctgttccattgttggttttcttggttccttttccagtatctttatgggttctgatattgtactgtgcaggcccattttgaatgggaggtatgtttctttttctctctttttgtgtactcccattcttcatgtcctgtgttcttctgctgtgcccaaccctacctgctgaatgagaaacgtacctgatcttttgacactgaaaccggaatcttcgctaaaaggtatttggtagttctgtcctacaatgatactggaaatattcacaggtccattcacagagctgacagactgcttggcataattcaggtcatgatactttgattgcattctgttctcttcctgggctggcagcttgctaaaagtcagaattccagatggcagcctttctctttttctgagtatatatatatgaatatatttatattcccttatatattttatttatctttataaacctatatctatatcagatctttcacaaatctttttgagcaaatagttttagttccttttaccttacaggagataagcttttctatttctagatttatatcttagcaagtatgtactcttaccttctttgctgctttgcatatttgtctatttcttgtctaaagatatgtttgtcttgtttttgaacttgccttcatgttttcagttttcttcctttattttttctatcactgctagcacataaaagtgtgaagttacagagtcatcttgacccgaaatcccccattttctttttttattatgagaaaacacaaaaatgaaagatcaaactaagttcttgcctttgaagggacatgtacatagaaaattgtctttaatttgtgagaggtaggatgaaaaaaaagttaaccaagccatttggaagtgccttcatgattttgcagtctttaaatttggaaggactaatttctttggcttttctatctcaggtttgttttgtgctataggcatttgaatgcatctgtctcatatttttttttccagtggtatatttcaaaagcacataagtaaagtagtttgttttttttttttccagagagaaatagaacgtatggatttttttttctttttaaggtacctatgttttatttgtcaaatctggtggttatatgagttattggcatcaaaccataatgaaattaaatgctttaaagcagtatctcattgctgggctgaaggtgtgtgaaacctagttcatgtataattgcagcatgaagccatgatgtaacagtaagaaaactgaacagcaccaactgcttctagggaatactgcaaaattgatgatgatactgaatgctttcacaggtgcaaaacataaatgttcttttctcttgtctttaggcttggcaattacccaacaataacactggcttgtttattttagattttgggcatgcattaacattgctaataagtttttcctctcctctcctctcctctcctctcctctcctctcctctcctcttgtcccctcaccccctcccctcctttcctttctttcctttcattttcttagttaaatgttaaaaatgaatgcaaaaatgtctatcttccagattttaattatttccagattaataacttgaatttctgaccaataatagtttgccttaatgtatactgaataaatgtaagtctattgctctgaagtgaatagtagcatatgaattaagcattaactcagaacttttatttaaaagaatcttcttaggctacatttaagatagaaagagggtaagttcagttgttagcaactatgatctccatgctcagccagaagttttagctgactagtgacagctctacatgagaatagctgggatgggagactcagagcccagagactcagtatcagcagatggcagtaaaggtacatggcagagatggaggcactgaaaggaatctgatccctacaaagactaacttaagatctaattgatagcattattgttttacctccctgtttgtaacagggaaacatggaaaatatatttcaaaaattagacattaggcagtatgggtgaaactgtccagagacatacagctttccttaccacttcacttatccagtgtgattgtcatggctgggtaagcaaatttaaggaaatgctgtttcctaaaagtgggatggttttcatacagccctatcaacacagccatatttcttgacattgtctgtgcaactcagcacaaaataaatgttaaacagtataaaaaaaggatcacgcataaaagccacagtgtcaggacttttgtctagcaaaagcaatataaacacactgtttttaaaaagcatcctgtttttgcttagatcgtcacagagttggccagcctgacagtacaaagagctttgtataaaaagcgctccatgacctctaataagtgatttttctgagcacttcctgcctctggatgatagtcatgtggcggtcactagttttagattatattagttagacttctctctgacaaaacagcccaaatacactttataataaattacagagaaaaccaagccattttcctgtgatgtactgatattaaaaaaggatctgtgatgattcctgaggaccactgaagcagaaacttcacttactcccttgattaaacagagcagtcgtcaagggaacatacaaccagccatcacgagatactggagattttccaagaactgtgattttctttccgactacgctatccaattcacgtgcaatgggactcgcagcatattctctagatttcatggtctcctggtagcgcctctaaatgtgtaaatgcccagaattctcttgttttctttagccggtaaaagcattcatataatgacaattacaattacacaaatataaatttgcatccagaaagcttcctgttttttttgacctgacatccatttctaacctctctgaacatgttgatgatgagtgtcaatgggatgctggaggagcctggcactagctcgtgagagctaattttgcatatctttcccaaatgccacattcagtgaattcatattgttagcttgaaatataggccatggtaaaagtatttattccagggaaagtggcaaatgctacaaatcaccaccccaccctttttttttccctgagagatgattcttaaaaaccagtatgccactgagtttcttgaacatttcttagtagcatttaagtattcacttagaacaagggcattaggaaagctgaaaagctcaacttcactgttgccatttcgtttgagatttcagtaaaaaaaaaattctttttctttttggaatctattatttcacagttctagattgggctaattcactctgatggtgaatgtaagttctaagaatattaccctaaaacctacacatgttcagtttacaaatacgagatagtatttaattttattctccacttccagtacttattatgtactcaatttatttggtttttagtagttttaggggtgttcactcctctgagtaatcaattaaaactcaggacttaaaacattgatttctgatcctttcatctcaaacatttgaactcacacacacacatattttgaaagaaagaagtttttttttcaagttaaaagaccgtatggaaaaactcaattaggtaacaagcagatcactttaccaaaatttaaacaaaaagtaattcagatgatattggtaggtggagattcactcacattaggtggtaaatgaaaaggccatgtgtgtccctgccatttttttttttacaaagatatgttacagtgagggattctttttataaaattgccttaacattaagtatgtagtttttttgttttctaataatacttcagtttccaaatggttggtactatttgcagtacataattttcctgacaatgcattttactgagatttatgaagaaacagaaaatattttaatgttaagatatttatactgtattatgtttaatccagtgaagtcagtaataatcctagtttcacatttgtattaaaaatatgaagagagagtagatgactagagatgtaaaacatttaaatttctgaagcactctctgagccaaagttgtaaatatacttatcactctaagtgtaaaaaggctacagtgtgatccattgggtgagtcttggatcaatacctctttggtttctggtttctctaccagctagcacacagtctaaatatcctttggcttggcttatttagtctttttttattttttttttttttggtttctgaggttttaggtacaccacttccccttctaactgtcctttctataccctttgtcaaacatgactcccccatctttaaaatttcctatagggagagaagaacagttaaaaccttaccctaggcaaactttcaatttggagataaccaagacatgtaaacttttagaaattcaaccaatataaaaataggtagaactgatgaatatctgtaatctaggcttaatgattgaaagaagagttactagcccttctttaagtcaatttcttataaatagcttccacaagagcactttcaatttaaagattgagaaaaatttaattgaataagtaaccatgatgatgaaaaaaattgctttgttttgcactcttacaatagagataataattcctggagttgtttctgataaaaaacaattacactaaacattttggaatttttccagaagatgatacataaaatttgagtagaaccaaaatccacatctcatataaagagaaaaatcactgatggttagagacaatggtttgaatgttttgtactgctttatataaatagcaaactaaatattgcaaggctcataggctcaagaccacaggcaaatttaataaactctaaaaatctataatctgtgttaattttatttataaagtctcaatccaataatgatttaaggtagctttaaatataaggtaaaatagcaaaaaatagaagaaaaaaagaaaaaattggtaacacaataaaggataaaagaaattagttttcagggaaataatttaaaatacaaatgaaaatagatctattgattcaacagacaaatgatcgaatgcctattatataagaaatgtaggtgataggtgatggtgaggtgaaggtgaataaaattgttgtaatctgaaggtcctcacagagggtaagaaggaaagacattgtcattctctgagaggtcagttttcactggaaccagaggaagcatagccagggcacctgcatcagcagcataggttagtgttaatgagggctgacaggtttgtgcaccagcttcaaggctgcattcaaatagagacagcaagtaatgccaggatgagtttacacatagaacacaagctgggacttcttggtttccaggcttatgaggcaaaaaggaaagtaaggaattctgagtgctgagctttgttgcttctaggaaacaaagaaacaaacaaaggaactatgttttctcccatttttggcttttttgctccttttctttagcaaattccatttcaccacctggtacctttgggctgctctgtcctgcctcctattaaaagcaatgcaaccaatcaggacagactggaataacatgtttcaaagtgacagagaccttcacaggggtatgtttttattattagcaatagcttcttataatcaaatactgtataatggaattatttactttatttaataaacatttatatagcatttattatagaccaggcattatctcaagtactttaaaatattacacagcagccaccctctgagataaatggaaacattcttcccatttataggtgaggaaattgaggcacctaggggttaagtaatttgctcaaggtcacaaagttcataaatcacagtgctgggttataaacctgtacgttgtagctccagaatctatgctattggctgctgtgtcatacctttttgattttttttttttttttttgagacagggtcttgctccgtcacccaggctggagtgcagctcactgtagcctcaatctcctgatcacatgcaatcctcctgcctcagactcccaagtagctgggactacaggcatacatcactatgcctggctaatttttgtattttctgtagggacagggtctcattatgctgccaaggctggcctcaaactactgtgctcaagctatctgcctatgttggcctcccacagtgctgggattacaggtgtgagccaccatgcttggcctctttttgatttctaatgagggtattgtacatttcttattcgtctcttgttagctaatctatctctgattagcagcaaatgactaattatttagcttaactgagacaggaaagcttttcaattcctttacttctgaaggtatccctgtctccaccactcactctgttctcttaagatggaggactcccttcttcctgtctcctttaatcataatctttccatcaattgcactccgcatgtccttggtcttttttcctctaattcctgtcctctgcttgaaccttcctaggctgctgtcatatccatcactaggactgaactcttatatgagtgcaaaggcaaggagggaaagctgaaagcaaaatctgttgagaccccacaaacactcctttctggaccttgttaatagcaagtaacaggaaggagagggaggcatactaccacaccctgtagtgttggtggcaggttcctggcagggtacctagaagagaattacagtgcctgacagggctgtgagagtggatttatttgggaacatctgtgatctacaattgtgggactctctgcatgctgggggtgggagatctgtgggtactgaagatgttcaagaagctgcattactacaatacgagatttcatttgtttccatggtctggtgaggtctcataaaaatcaggtaatgtcatattattccatagttgttggttttgtgtctgtttttctctctggccttctgttcctcaggttcctccctggtagcctcagctgtaagtacagtacctgatgcataatgcacacaatgcacatatgctgacctgaagccagtgtacttgggtgatgtgggaccaaacaggccagtggaactgtttcttagacaaaccatttttctttacctgctgtctgctctacccacagcccagtgacaattctatctgctctccctgtgtgaaaggttcatcctttagcacatctgctcattaatatgaagtggtgagaacagtcaatatgctcgtaatgatagacccaactctcaacctaactagctgtctatgttcgggcaatttacttaaacctctgggcaatttacttaaacctctctgagtttcctgatacataaaggaacttatacattttcattgaccttctaaacccttatattctctcatattgcccaatgttcgattattttgtataagaaataatatgttgggaaatcagagatccatgcagtagcatttctacctccattttatttataaccatgtcttatgtgtaaaccttggtgccaagtttattcctacttagtcctgagaaaagacgtggaatacacacttatacacacacacacatacacatatatatacgtatatgtatatataaatatgtaaattaaagctgaattcaggagtcaagatatatttgaaaaatatgctaccatgggatatttcatttgaaaacgtaaattaacacagtttcctttggaaagtagataaagaaatagttgtgacctagatatagtataaacctcagattggattcataatagcatacctcaggaaagtgatctcttttatatattcaggggttttttgttgttgttgttgtttggatgtttcttcttgctttctcatcaaatctaaactctttaaatatctgcattaagaatatgttttgacttgcacattgagtaagaataaactaatactcataggttttgcaattatacagccgaatagcaaaaaattttttgtggtgtctcaattgaaatttgattttggtaacatttttggttttcatatgctgatgtctagcatatggtagaaaaatggccccctcaaaggtatttctatatcctaattcttagaatctgtaaatgttactttatttggaaaagggtctttgcaaatgcgattaagttaaagttttttgagatgaagagatcatcctgggttatttgggagtgtcctgaatgtcatcacaagtgttttttttttttttttttttttttttttttgtcgagacagagtctcactctgttgcccaggctggagtgcaatggcacagtctcagctcactgcaacctctgcttcctgggttcaagcaagtctcctgcctcagcctcctgagtagctgggactacaggcgcatgccatcatgcctggttaatttttatatttttagtagagacggggtttcgccatgttggccagactggtcttgaactcctgacctcaagtgatccacccaccttggcctcccaaagtgctgggattacaggtgtgagccaccatgcccggctcacaaatgttcttataagagagaatcagagagagtgaatgattggagactcaggggaaacggtaatgtgaagatagcaacaaaacctggaatgatgcaaccacaagccaaggaacaccaaggaatgccctcagttggcagacgctggaagaggcagtaatggattttccctcaggacttctggagagagtgcagcctgcctacataacatcttgatttcagacttctggtttccagagctgtgagataataaatttctgttgttttaggccacatagtttgtgtccatttcttatagtagctacaagaaacaaataaagggcaagatattttctttctttcctttttatttttttaaacggagtctcgctctgtctcccaggctggagttgagtggcgtgatctcagcttgctacaacccctgtctcctggattcaagtgattctcctgccttagcctctcgagtagctgggactacaggcacaggccaccacgcccagctaatttttgcatttttagtggagacggggtttcaccatattggccaggctggtctcgaactcctgaccttgtgatctgcccgcctcggcctctcaaagtgctgggattacaggcatgagccaccacgctcagcctcgttctttcttttttaaatgaagtaatgttaaaaataagaagcaaaggtttgaatactaacagtgttcaatagttgaatttggagatgaatgagattagaatgtgtatatataagtatatatatatatatgtatatataagtatatatatatatatatacttacatatataagtgtatataagtggacactctattaagatatacagataatctgaatgctttgggtttaacaaatacctcagctgtgcagaggctatgaaatagatcagaaagcaatagtgtatctcctcttaacattttcgcagagtaatcagtgacaagaaacactgataaaatcaacataactctattacaaacatctaaactctagtatctacatttattgctattcaaatagagtaataacagttaggtagaaggaatgaattcttgtttgatagcagagtagggtgactatagttaacaacaatgaattgcatttttcaaaatagctagactagaggaactgaaatgcagccaacacacagaaatgacaaatactatggtggtgaataccctaagtatcctgacttgatttttacacatacaatgcatgtacaaaattttacatgtacctataaatatgtataaatgtaatatatcataaaaccttttcctttaaaaatgttgatgaaatgttttcatccaaattacataaacatacacatttgtttacttaactaaaaaaacaccaaaccaagtcacgaaaacattgtaacagacttctgtaaagtataaggtagattatgttcactattattcctgataccaagggcttcatggggtgcaaatagatgtggtagtaacaggaaaagaaatggtaaaaattatccaacaatttccattcctttcacatgtgatattttagactctaaaacatccccacttgattattttgggtgatttttggggatggattatatttactacttatgataaaaagaaatattgatattccagagttttaccaactgtattttattgatagacagtcaatgcagcaaacttttccatggtgggttatgttaactttgaatcatctgatatgctagataatgtcctaatcttggggagaatattataaatgttaaaataatgtattattaataccaaagaaagatctcaatagtggtgccatagacagatggagaaaccctatttttgtattaaaggatttcctgggaatccaagaattatgatgactacagaagatcctctacattatattgtgaaaatattaggggaagaaccaagaaatgtccacaaatgaggaaaccttatcattattactatagtcttcctaaaaatcttttctacccaaaagcattttcttaattgagaaatggttctcactttgtctatttctcatccaaagactaaaattccttgcagtgatagttttcaagggaaaaaaaaaaagccttttctttattgcttagtagctttgctgctgtttttgcaaaagccattctttttctttccatcacaattaccctttattgagcattttcttaagccaggtactggattcaacgccacacatgatctatctcaaggcagtagtgctagactggggggagtttgcttcctggggtacatttgacaatgcctagatacatgtttctttatcacaacagggaatgaggatgctactgacatctagtaggcagaggtcagggatgctggcaaacttcctacaatgcacaggactgcctggaataataaagaaggatacagccctaaattgtcaacaatgcacatcttgagaaaaatgttccaaagtaaaagctgagtgattgttcatcagctaaataaatggtaagtcttgttataagtaggaggaacaatgggacatggtttttctacaatggatgaattgaaaagattatcatatgttgtaacatttttctatttgtagggaatacattcactacattcacatggtccaagattcaaaagatactcaagaagttgtagtccaagtctccctcccaccccatccctgtttcacccaagttccctccctggaggaaactgttagtaatctcttatttagttacctaaaagttctctaggcctctgtaagaaattatatacatgcacagaaacatactatacatattctttgcattgtgcttttgttacaattcattttggagattgttttctatcatgatacaaagcgtttccccattatttctttttaagatagcaaagtatttcattgtaggttgtatgcaagttttctattttatgtaaccattcccctctctatggatatttagattatttcctttttttctgttacagacactgatcaatgaatatctttatctgtgagtttaagtcctacaaacagaattgccaaataagcacatttgtgcttgtaatttttatcagatgttgtccaaattaccctccattctccattaaattgaatatgtttccattcacactggcaatacatatataaaggagtttggataactttataattttaaaagtttttctcattcttttcatcaaaacctgagaataaataagaggtggacacacaatataatattttctgtctaaaatgttctcagcactcaggtatccagaatctattcatgggagatattttttttctaatctgtttttagtgcgctaaaatatataacataaactttaccattttcacaattattgtgtacaattcattggcattaagtacttttataatgttatgcaaatatcattattggctatttctaaattatttcatcacaacaaaaagaaactaatctgtgaaagctgaaagaatttggtcattcttgtcatacccagctaaaacagagttcagagccagaaagaaaaaagcacccagggcacataacatttcttcaagaatgttattctctgcaagcgtggctgctgaaactgcctgctccaacctgaaaccagttttattcaatatctactgaaacaggctgctgtgactctaagaatagttttacccacacccatcacttatttagagcttaccagctccccaaaactagtgccaatgaattttcctgaagaacaatacataacatttcttctttttataaaaccgccaaccttctctttgttctttagacatagcaaagaccaccctgtctgtgtgtatgccctgaaatgaaattcttgcttctcaaataaaacgttttatatttagagatttgtctttaattttttactcgacttcaacaaaccattatgcaataattccccattctgcccttctctagccactggtaacctttgattaatttctgtctctatgaatttgcccattccatatagtatatttcacataagtggaatcatataatacttgtctttttgtgtctggattattgcacttagcataaagttttcaagattaattcatgctgtagcaagtatcagaacttcatttcttcttaggtctgaatagcatttcattgtatgcatatagcttattttaaaatctatttctctgttgatcgatacttctccatttgggttgtgaacaattctgctatgaacattgacatataagtatctgtttgaatccctgttttcaattcttttgcatatgcatctggggtggaattgtgggggtcatatagtaaatacgtgtttaacttttagagcaaccattaaactgtttctaccatttgtagtgtaccattttacgctgtacatggtaaaatgtacacttatattttacactttacattgtacggtgtaaaatggcatggtctcgatttttccacagcttcaccaacacttgttatttttctttttttaaataaaaattatggccattgtagtagatgtgaagtggtattgagaggcaacagtgtgcgccctcactagctctcggcacctcctttgcctgggctcccactttggcggcacttggggaggccttcagcctgccgctgcactgtgggagcccctttctgggcaggccaaggccagagccggctccctcagcttgcgaggaggtgtggagggacaggcgcgggtgggaactggggctgtgccgcggtgtttgcgggccagcgcgagttccaggtgggcgtgggctcagtgggccccgcactcgtagtggccggccggccccgccagcccagggcaccgaggggcttagcacctgggccagcagctgctgtgctcaatttctcaccgggccttggctgccttcccgcggggcagggctcaggacatgcagctcgccatgcctgagcctccccctctctctgtgggctcctgtgctgcccgagcctccccgatgagtgccaccccctgctccacagcgcccagtcccatcgaccacccaagggctgaggagtgcaggcgcagggcgcaggactggcaggcagctccacctgcagccctggtgcgggatccactgggtgaagccagcggggctcctgagtctggtggggacttgcagaacctttatgtctagctaagggattgtaaatgcaccaatcagcaccctgtgtctagctcagggtttgtgaatgcaccaattgacactatgtatctagctactctggtggggacttggagaacatttgtgtggtgacactctgtatctagctaatctggtggggacttggagaacatctgtgtctagctcagggattgtaaacgcaccaatcagcaccctgtcaaaacagaccactcggctctaccaatcagcaggatgtgggtggggccagataagggaataaaagcaggcttcccgagcaagcagtggcaacctgtttgggtccccttccacactgtggaagctttgttctttcactctttgcaatgaatcttgctgctcctcactctttgggtccacactgcctttatgagctgtaacactcactgtgaaggtctgcagcttcacccctgaagctagcgagaccacgaactcaccgggaggaatgaacaactccagacgtgccaccttaagagctgtaacactcactgcaaaggtccgcagcttcactcctgcgccagcgagatcacgaacccaccagaaggaagaaactccaaacacatccgaacatcagaaggaacaaactcccgacgcgccaccctaagagttgtaacactcaccgtgagggtctgcggcttcattcttgaagtcagtgagaccaagaacccaccaattctggacacattttggcgaccacgaagggactttcgcctatcgcccagtggtatgacaatcaccatgtggtgagaccatcgcctattgccgagcagtgagacaattgcctatcaccaagcagtgagtaccatcagacgcctttcacttgctattctgtcctatctttccttagaattcgggggctaaataaccgggcacctgtcagccagttaaaagcaactagtgcggctgccggactaaagacacgggtgccaggctttctgggaaagggctctctaacaacccccaactctttggagttgggaccgttggtttgcctagaaccagcttccacttttcctgtacttctgggctgagctgaggatcgacagagaggaaagctgtgcagctccgaggtcccaacaacaagttggttgaccctgcagccatgagcggaactctcaaatgcatgtcgcccaagcaagactcacccatctatcctatctatcctgacccttgccccttgggtcctaatgcctaccagacaaacttcctctcgcctctcttctctgaggttagtcctccttctaaaaattgctacctgtctctggtgcttttctagtttctcctatgagaatgatttctagtataaactccaggactctgttaccttctttaggcacctgggctcaccaatcagaaagacataatttttgcccaaagctccgtcatagtggggactacctggaatttaggatccctcctcagactaacaggcccaacaaaagctgttcccgaagctaggatatggggagcctcagaaagtgtatccttcctattcatataagtgaagacaaaaggtgtcactcttccaaccctggagatcccttccctccctcagggtatggccctccacttcatttttggggcataacatctttataggaaaggggtaaagtcccagtactaacaggagaatgcttaggactctaacaggttttcgagaatgcatcagtaagggccaataaatccgatttttcttggtcagtcctccttgtggtctaggggacaggcaagggtgcaggttttttagaatgcctcagtagggactactaaatccaaccttccttggtcctccatgtggtccgggaggaaaactagtgtttctgctgctgcgtcagtgagcgcaactattctgatcagtagggtcagggaccgttgtgggttctggggcaggggttgtttctgctgctgcatcagtgagcacaactattccgatcagcagggtccagggactgttatgggttcttgggcaggggttgtttctgctgctgtgttggtgagtgcaactattccgatcagcagggtccagggtccgttgtgggttcttgggcagggggaagaaacaaaacaaaccaaaaccatgggcggttttgtctttcagatgggaaacactcaggcatcaacaggatcacccttgaaatgcatcctaagccattgggaccaatttgacctataaaccctgaaaaagaggcagctcattttgtttctgcactatgacttggccccaatattctctctctgatgggaaaaatggccacctgagggaagcacaaattacaatactatcctgcagcttgaccttttctgtaagtgggaaggcaaatggagtgaaataccttatgtccaagctttcttttcattgagggagaatacacaatatgcaaagcttgcaatttacattccacaggaggacctctcagcttacccccatatcctatcctcctatagctccccttcctattaatgataatcctcctctaatctcccctgcccagaaggaaataagcaaagaaatctccaaagtaccacaaaaccccctaggctatcggttatgtccccttcaagctgtagagggaggggaatttggcccaacccgggtacatgtccccttctccctctctgatttaaaacagatcaaggcagacctggggaagttttcagatgatcctgataggtacatagatgtcctacagggtctagggcaaacctttgacctcacttagagagatgtcacgctaccgttagatcaaacgctggcctttaatgaaaagaatgcggctttagctgcagcctgagagtttggagacacctggtatcttagtcgagtaaatgatagaatgacagccgaagaaagggacaaattccctaccagtcagcaagccatccccagtatggatccccactgggaccttgactcagatcatggggactggagtcataaacatctgttgacctgtgttctagaaggactaaggagaattagaaaaaagaccatgaattattcaataatgtccaccataactcagggaaaggaagaaaatccttctgccttcctcaagtggctatgagaggccttaagaaaatatactcccctgtcacctgaatcactccaaggtcaattgattctaaaggataagtttattacccaatcagccacagatatcaggaggaaactccaaaagcaagccctgggccctgaacaaaatctagaggcattactaaacctggcaacctcggtgttctataatagggaccaagaggaacaggcccgaaaggaaaagcaagatcagagaaagtccgcagccttagtcatggccctcagacaaacaaaccttggtggttcagagaagacagaaaatggagcaggccaatcacctggtagggcttgttatcagtgtggtttactaggacactttaaaaaagattgtccaatgagaaacaagctgccccccatctatgtccactgtgccgaggaaatcactggaaggtgcactgccccagaggacaaagtttccctgggacagaagcccccaaacagatgatccaacaacaggattgagggtgcctggggcaagcgccagctcatgtcatcaccctcactgagccccgggtatgtttaactattgagggccaggaaattgacttcctcctggacactggcacagccttctcattgttaatctcctgtcctggacgactgtcctcaaggtccattaccatctgaggaatcctgggacagcctgtaaccaggtatttctcccaccttctcagttgtaattgggagactttgctcttttcacatgcctttcttgttatgcctgaaagtcccacacccttattagggagggatatattagccaaggctggagctattgtctacatgaatatggggaacaagttacccatttgttgtcccctacttgaggagggaatcaatcctgaagtctgggcattggaaggacaatttggaagggcaaaaaatgcctgcccagtccaaatcaggttaaaagatcccaccacttttccttatcaaaggcaatatcctttaaggcctgaagctcataaaggattacagaatattgttaaacatttgaaagctcaaggcttagtaaggaaatgcagcagtccctgcaacaccccaattctaggagtacaaaaaccaaacggtcattggagagtagtgcaagatcttagactcattaatgaggcagtaattcctctatatccagttgtacccaacccctatatcctgctctctcaaataccagaggaagcagaatggttcatagttctggacctcaaggatgccttcttctatattcccctgcactctgagtcccagttcctctttgcttttgaggatcccacagaccacatgtcccaacttacgtggatggtcttgccccaagggtttagggatagccctcatctgtttggtcaggcactggcccaagatctaggccacttctcaattccaggcactctggtccttcaatatgtggatgatttacttctggctaccagttcagaagcctcgtgccagcaggctactctagatcttttgaactttctagctaatcaagggtacaaggtgtctaggtcaaaggcccagctttgcctacagcatgtcaaatatctaggcctaatcttagccagagggaccagggccctcagcaaggaacgaatacagcctatactggcttatcctcaccctaagacattaaaacagttgagggggttccttggaattactggcttttgtggactatggatccccagatacagcgagatagccaggcccctctatacactaatcaaggaaacacagagggcaaatactcatctagtagaatgggaaccagaggcagaaacagccttcaaaaccttaaggcaggccctagtacaagctccaggtttaagccttcccacaggacacaacttctctttatatgtcacagagagagccgggatagctctttgagtccttactcagacttgtgggacaaccccacagccagtggcatacctaagtaaggaaattgatgtagtagcaaaaggctggcctcactgtttaagggtagttgcagcagtggccatcttagtgtcagaggctattaaaataatacaaggaaaagatctcactgtctggactacttatgatgtaaatggcatactaggtgccaaaggaagtttatggctatcggacaaccgcctacttagataccaggtactcctccttgagggaccggtgtttcaaaaatgcacgtgtgtggccctcaaccctgacacttttctcccagaggatggggaaccaatcgagcatgactgccaacaaattatagtccagacttatgctgcccaagatgatctcttagaagtccccttaactaatcttgactttaacctatatactgatggaagttcatttgtggagaatgggatacgaagggcaggttatgccatagttagtgatgtcaccatacttgaaagtaagcctcttcccccagggaccagtgcccagttagcagaactagtggcacttacccgagccttagaactgggaaagggaaaaagaataaatgtgtatacagatagcaagtatgcttatctaatcctacatgcccatgctgcaatatggaaagagagggagttcctaacctctgggggagcccccattaaataccacaaggaaattatagagttattgcacacaatgcaaaaacacaaggaggtggcactcttacactgccaaagcaatcaaaatgggaagaagaggggagaacagcagcataagcagctggcagaggtagggaaagaccagcaagaaggaaagagggaaagacaaagagaaagagacagagagaggaagagacagagagacagaaagtcaaagagggagtcagaaacagagacaaagaaaaggagtcagaaggagggacagacacagaaagtcaaaaagagagttaaaaagagaggaagagacaaagaagaagtcgaagggagaaggagagagatggaagtagtaaagaaaaaacagtgtaccctactcctttaaaagccagggtaaatttctgtctacccagccaaggcatatttttcttaagtggaatgtcgacccatatctgcctctcagacagtttgcaagaaataacgaaatctattcttactttacaatcccaaatagactctttggcagcagtaactctccaaaactgccgaggactagacctcctcactgctgagaaagaaggactctgcaccttcttagggaaagagtgttgtttttacactaaccagtcggggatagtacgagatgccgcccggcgtttacaggaaaagccttctgaaatcagatgcctttcaaattcttataccaacctctggagttgggcaacatggcttctcccttttctaggtcccgtgtcagccatcttgttattacttgcctttggaccctgtatttttaacctgcttgtcaaatttgtttcctctagaattgaggccatcaagctacagatggtcttacaaatggaaccccaaatcagttcaactaacaacttctactgaggacccctggaccaacgcgctggcactttccctggcctagagacctcccctctggaggacactacaactgcagggccccttcatcgtccctatccagcaggaagtagctagagcggtcatcggccaaattcccaacagcagttggggtgtcctgtttagaggggggattgagaggtgacggcgtgtgccctcacttgctcttggcacctcctctgcctgggctcccactttggcagcacatggggagcttcagcccgctgatgcactgtgggagcccctttctggtctggccaaggccggagctggctccctcagcttgcggggaggtgtggagggagaagtgtgggcgggaaccggggctgcacatgctgtttgcaggccagcatgagttctgggtgggcatgggcttggccagctccgcactcagaggggctggccggcaccaccggccctgggcagtgaggggcttagcacctgggccagcagctgctgtgctcaatttctcgccaggccttagctgccttcccatggggcaggactgcggacatgcagcctgccatgcctgagccacacccccaacccccaccctccatgggctcctgtgcggcccaagcctccctgatcaggatcgccccctgcttcatggcacgcagtcccatcgaccacccaagggctgaggagtgcaggcgcagggcgcaggactggcaggcagctccacctgcggcccggtgcaagatccactgggtgaagccagcggggctcctgagtctggtggggacttgcagaacctttatgtctagctaagggattgtaaatgcaccaatcagcaccctgtgtctagctcagggtttgtgaatgctccaattgacactctgttatctagctactctggtggggacttggagaacttttgtgtggtgacacgtgtgtctagctaatctggtggggacgtggagaacatctgtgtctagctcagggattgtaaacgcaccaatcagcaccctgtcaaaacagaccactcggctctaccaatcagcaggatgtgggtggggccagataagggaataaaagcaggctgcctgagccagcagtggcaacctgctctggtccccttccacactgtggaagctttgttcttttactctttgcaatgaatcttgctgctgctctctctttgggtccacactgcctttatgagctttaacactcaccacgaaggtctgcagcttcacccctgaagccagcgagaccacgaactcaccgggaggaatgaacaactccagacgtgccaccttaagagctgtaacactcactgcaaaggtccgcagcttcactcctgaggcggcgagaccacgaacccaccagaaggaagaaactctgaacacatccgaacatcagaaggaataaactcccgacgcaccaccttaagagctgtaacactcaccgcgagggtccacggcttcattcttgaagtcagtgagaccaagaacccaccaattccggacacagtatcttacatggttttgatttgcttttccctaatgacaaatgattttgagcacttctttgtgtgcttattggccattaaagggaaaaactttttctatatttacaacatttctgacaccaaatgtgtgggttttctataccacgtgtctgtggacacaaactgagcgtcctacaatttaactcagttctgacactatctggagttagcacagaccctacgggttaagggctcaggcccacaagactaatccttgcttcagatgtcaatctgaagtaagtagtgggtctctagattacctatacatttgtctggcttggctacaaattgggggtacacacagcccacccttgattttaataatttgctattcagctcactgaactcaggaaaacacttttcttactaatactggattataaaggatactactcaagaatagccaaatagaagagaggcatgaggctatacagaactttcatgtcctttctagccatgccacccttctagcatctcaatttgttcacaaatccagacattctctgaactgcattgttttaacatttttatggaggttccattgcataattgagtaaatcattggccagtggtgattaactcactccccagccactctctcctctcttgaggagacttcaagagtcttagaagctcttttgtcaggaagaggggctaagaccaaacattgtaacagaagatgctcctatcactcaggaggttacaagaattttagaagctctgccaggagctagagacagaaaccacatttagatttcttattatgtaacagctgtctatatgtctactctgaagaaatgtctagtcaagtttttgctcatttttcattacattatttgtcttgttgttgtttctacttctcatacagtgagtcaaaacacttctcatataatttttcacctactcatcgtaagtctacttccgttagagaaaaaaggctccttttactctaataggcacatagctattaaatgtggttttctggtaaattctgaaaagactttttcaagagataaagatgaaagtgaaacatatcaaagttttattccctaaaatattttaagttaattcaagaaataattttcatctctgaacctgaaaaagagtactaataaataaatttctaagcacgcaatagtaactataataataaggttaattactgtctaaaataggtcagaagtcctgctgcaaatatttttaaataaattatgtaaacttggacataacaccttcattaattgtcaaaattttttatctatttaaatttacatttaaaatatttaacaggttaattatattcagatcagataggttgctacaaaaacaaatttaaaattattagaaaaattagaattattgttttctagaacttccccattcaaactagttatgttgataatgttgtgtatacatacattcaattgttgcaaagtaattctgacacaaatgagattactctctctctctctctctctatatatatatatataaaattgggagtggacttacattgttaaaatatacatataatctaaagaatttggccttaacaaatattcaggtgtggagtagctgagtagtatcttgaacatttttacagtatagtctaatttgtcaggagcactgatttaattaacataaattcaacaaaacaaagggaagtaaaaatggatctagattcctaatagattgttattggtcatgcctgtattgggtaatggtctgcaatagcagggcagtcaaattaaatggtaggccaaatccagggtccagtaagtgttagattaaaattaaaacaaacaaacaaaaataaagttgaagacagaatgattgaggggagcaataaaaagtgataatacatggtacttgttaataccaccactactagtactaccaccacaactagcttacaattgaataatacttgccaaatgccagagaccaagtacttttatatatgtactacatatattagctcataacctccagatgtaggcaatgttatcttacggtatttattttacagataaggtaatcaaaacacaggaatgcaagtgacttgcacacactctcaaggagcagagccagatggggccccaagcagcctggccctgagtctgcacacttaactcttatcccagtagttcccaacgccatctccacattggaatatcctggagagactcaaaaaataacagttctcaggtcataaccaagagcaattaactcccagtctgtgggagtaggacacagatgccaagggttcttgaagcttccgaggtgattcccatgtgcgaccaagtttgggaatctctgtactatgctatgctgtcttaaagttgtagaggtcaaaggaagcagagttattaggccaggaaataatccatctatggcattaagaggaataatggacaatcaagcatacagtgaataatgacaagcaacacgaggcattctcttacaactaaaggaaaaaaaaagagtctaagctgcagcaagatgaaattatatatttctatttttaatatcttaccaaagcaacatgtggtaatgagaattttaaggaataaggcatctgctttctgtttggaattaaaagggatattatgtttataaacagagaatagctagacgtcaatgtctggagattgtcacagctgaagggtggggtggaggctactgacatgtagcatagagaagccagggatactgctgaacacgtggcagtacacatgacaggccccacagcaaagacttatctggtccttagtgtcaatagtgtccagtgtgataaactctttaataatgactattttaattacagagacagtaaagagattaagtgaattcaatttttcttcatctaggattatggttaatttgtgtttactcaacaagcatgacagatttatatgacagtattagaataattacaacaaccattgaattcctagaaactatactttcatgctagaaaattctttagatgtgatggtaaatgcagttatagccttaaaaatctatgactcatagggaggagaaagaaactaggtagggcagggctagatatggaatgacatctcaaacatgtccagaccactgaatgaggaaatcagagccaggtcttgcaaatactccgatgttggttctttgaagcctaggttatgtttagtttcacctgcctatgaagaagtaatacactttctatgaaaccagagtaaagaatcatgtaagatgcaactacatccctgaaaatgtgcaggggaaatttgacactttactcaaagtaatgacagtaagaggacaaccttcaaagtgatgcatcttattttttcttattgcataataattgtattttcatgtcatcctaaatgcttttttcttttaaaacatttttcactgcagtgctttaaaaatttttaatttttatctctttaaattctattacttttaaccttatataagaaagtgattattagaaaatctgattataagttctcagagattcactctagcatatcttattaaaattggattctgggcttagctctgaagttttggtttggaaagctgtacttctgatcttcttgaaggcattagtttgtgttagtactaaagagtagtgctgtatgactgaaaagattttgaactagaattctgatttacacttgttctttctgtaataaccaaagaagtaatcttctaagagatcttatacagcaaattttgttgtataatacagtaatgtacagtgacaacttagatctagctggagaagtatttgttgcttctctgccattccagactaggaaacagcaaatgcaaaagcatgtaaagatgatagaacttaaagtataatagaaaaaaaaagatgataggactgttaagggtgatggagtttgggtgcagaatggggagtgagtagtgagagctaatgcaggagctacgtctcagatcatggatggccttaataatcatacaaataattttgggtatagaatattgaaaacttaatttggaaaagtaaaataatgagatttgtaatgtaatgacattgttccagacattagtgacattaatctggaatactatagaagagttattattctggaataatgtggaacaattttaatcttaatcttatggaagatggattagagagggttagtgtttaagtaaggagaccattgaggagctacagacatcacgcaggtgaacaatgagggcataaactaaggctgtcacagtggggataaagagaaaaggatagtttgagttactgagacatttaaggagtaacaaaaacttgggcctggattggctgtaaagtgtatgataaagaaggaggctaagtaagactcatacttactgatttaggacactgctaaatactttgcctatatcttctctttcaatctatgatgtaataaatgttatctaccttctacagatgaggacacttggcttaagtaacttgctctagaccacacggaggatagtggcaatgctaggatttgaactcgggaccatctaattccaatgcacatgatttcaactattcttagtaactaggatgagtattacaagaggaagagaatatttggagtgtgagataaaataatgcattatgttttggaaatgtggagcctcagatggccatggaacacaaaactagatcatataataggcaactaagtggaatttaaaaatgtggttatatactaccctgtcactttacattacagcttattgtattttataatgattacagtggcaaatatttttatatttttcccaaatctaaaaagactagtgataatggaagattgttccagaacatattgggaagtagactgtggaaaacggtcctattaactttttcattagtcatttttaaccacattatacattaacacttcagtacacttcacaaaatagcaatctgggctttgtattcaaccacatttagtacaaaagtggaaactaaattaaatacaatctagaaaacaaatagtgcaacaaatttcatgaatattaatagaaaaccagacaaatgtatttgagtttgcatcacaaaatgtgcaattcattcttttatggaattgctattttcaaacaaaatagattgctatagtcacttaaaaatgtaaaatgtgaaacatccatggaaaaaagataggcaaagattatgagaaatatgatagatttcccaatgagggaatgaggttttgaataaactactccccttggcagcatcttaacaagatcatattcaatgaatatgaatcattagtaaactatgaaacaatgaataaacacacacatgcagatgagatgctaggttgctacggatttactagctattccatctgtcattatttctgatttttcacctcctcctaaaatcattaatagggtacagagtcactgtgaattttatgcctgcctcaaaacacagaagggtttaatttattgaatgatattttattagttcagatgagttgaaatgtggcatttcattttctaaaactgtggaaacatcaatcatatagatacttaaattgtaatttaggcactgggtaaagtttcaatttatctgaataaaattgaataaacatccaaaatgaactaaaacatattttagatcaaattgactttttctgattagtggtcatttaaaatctccttatgcaaaattaatcaggtgcaatttcttttataaaaataaagaatagaatggtggttaccagaggctggggtggttgaggctgggggttaagtggggatgtggattgggggatgtggatagggcagatgttggttaaaagatacaaatttacacttagataggttgaatctgttcaggaggtctatttcacagcatggtgactacagttagtaacgatatatcattttcttgaaaaatgctaaggaatgcctactaaatattcttaccatgaaaatgataactgtgaggtaatatatatgttaattagctatattttaaccatcccataatgtatgtgtacttcaagacatcatgttgtacatgataaatatatatgattttacctgtcttaaaataaacaatacattaaaataaaagtcttatcttctagagctgaggttttgtcacttttaatatccacattcctaattgactatcaaaatccagtacttcattgtgcaatattaggatatactttatatatcctaatagtttataaaattatataaaatgttttataaaattaagtaaaaaatattgtgtgcataaaaatatcatgggcaatttcttttttcctccatttttttaatgatatgagactaattcttattctgaagatgtcttcacaaagtagaacatttttaagtggtttatttactttattctacctaattttctttttacttttgttttctttttctttctttctttttttttttcttgagacggagtctcgctctgtagcccgggctggagtgcagtcgcgcgatcttggctcactgcaacctccgcctcctaggttcaagagattcttcagcctcactctcctgagtagctagaaccacaggtccctacaaccgtgtatggctaatttttgtatttttattggagacagggtttcgccacattggccaggctggtctcaaactcctgacctcagatgatctgcccgccttgggctctcaaagtgctgggattacaggtgtgagtctgttctattctacctaattttcaaatacctgactggcctattctacctaattttcaaatacctgactgacaaatgtagaaatcaatatatcagatactttggtctacacaaaataaatttcttaatagatcattcattcagacagattgaatttttactttagataagaattacttaggtaagtattattgtgatggttactaaagaagaaaactgaactcttttggacaggaatctaactcaagtcaactgcttaaaggagagtaaaatttctgaggcatggtattgcaaagcaagggaatacatgttaaaaatattagaagcggtatagtacgagtaaatttgggaaatttgacttcaataagcatgttagagggataaataaaagaggaagctctttccagattaaagtttttacctatgaataattctacttttaaatagatccctggcaagacattctgggtttgagagtctggaattttgcaaatatactggttactaactggaataaaatatgtgctgcagtcttaaaatttatttaaatgggaatataaggttgccattgttttaatggcaaaaaaaaatgtttccatgaaatttatttatgaaatgaatgtgtggttgtagcttgagaggcaggaatttaggtgatgaggtagaaagttagaaagctacacattttattatttttggattctccacaatttttagaaaattctcataatttcccttttcttttatttgtacatatttgattattttgctattatcaacaattttaagaattttgatgtgcagaattaaacttaataacatagggattatttctaaatctttgatttccacattgcatacttaaatatgttcttagaaagataacctcatagcactgaaatagatggaaagaagaaattcttgaatggcaatgtgtccatatggcaagatagagcttgcaaagttaatttttcttaattagcagtaacttaatcagttccaagttagaactgaaaaaacgttttcagttcttttgtagaggtatccttttaaaataattcttatctctgcatttccataccgtgtaaattgagagtttgaagctactatatttaaatccagcaaacattttggcactaaacctttgtttctgtcttttgtgcttgtggtaatgtggtgatatatggaagatgcctcagagttactagtaatgctatgggggtggtggtgaatagcaggacaaaaattacttaagtgtaatttggaattgtagttggaatgcactttcatttcattatgtgtatttgataactcattgcttctgaaaataatcaatcttgtgaaagttaatgagcttttaaaaactgttctatgtaaacatttaggtagaattttaaattttgtattatttggaacatatacctattgattttcaaatgttaatttggttttattttctgacattttaaattggttttggaaattttaatatggcgcacaactaagataaaaagtattagtttataacctagacccaagattgaaaaactaaggacaaagagtcaaatacagcacacttaaaattttgttggaacacagccatatccactgatttacacattgtctatggctgctctagagctgcagtgacaaagttgagtagttcaacatagattgtatggcctgcaaaggctaaaatattcattatctggctctttagtttgtcagctccttatcctcgagctcctaaaaagctggagctgagctttacaattgcctatgaaaaataataattaagggcactggtataagggggaaaaatacaacctgtgtttaaatagaggtattcatttcaaaatctgcaatcagattttggttcatagaaaagaaaattttaaaaattagaatagactcaagagaaggtattcagttacattttaattttaaacatggtcatttactaagcatgggtagtgtgtttgtaattttagatgacctatacctttaagatttctgtccccttggggtggaggtggtagtggagctttgcctctttagatagtgggtgatagactctgctgattctgacagaaaggatcatatggacccccacagtttggaatcagttccatcatagatctgtacttgtgtgtgtgtgtggtgtgtatagtgtgtatgaaaaaaacaattcccttaaacgtagaactaaagtagactaaaatagttgcagttttcaggaaaataagaatcatggtacatacaaatttaaaagttggttgaatacgggaaaaataaattttctggtattaaagaggtctaaaatgcagccttcagtattgctcgttgaaaacactgagccaaaagataagtgctttctatgtagaaaatggtaagtgctttgccctttaaaaagagaatccagaaaatgttgcccttttaatgtcctgtagcctgccctggatttgaggatgaacagagatggcactaaaaatgataaagcaataaatcataaaccaccaaaattccttttgtatcaaagctcttacatgttcagaaggcaataacaatcttcagtacataccaatttccctatgtgggatggaaattggagaaactgtgacagaaaatactgaataggaataaaactgtctttgcctctttcattttcgttattttgaaatttttgctgtccacatattaattggaaatcttaatatatctaactgtaagtttatatctgaggcagaaagaaaacaaatatgggtctgtatgtcagctggaatccaaagtaaatatgatctttttttaaatgttcaaagcattttaggttcttttcactctcatcatgtgttacctgcctttgcttttcatgcatttgaaactcactcactcccctcttcatagttcttttttagtttctaaaataccagtgtaagtgagaaaaggtaaaaagctgttagaaaaatctctatcctttagaaagttcactaacacacaagataacatattaatgatgaacgagagcggaaatttctttatacttaaaaaagtaagaattataaggcagcaggtcatatttttggttagtgatggactggacttggagtcatttgtagaattaatttggagtactggtcaggatcaggaaataataattaattccatgattattaaagtttcttctgaatctttacaatttttacataaatgtgcatgcaatgccttgcttctcagttagtaacagggcttaactattttgtaaaccactttagggaaacatttagctagtgactggaaaatggggaataagtatgccctgctctattccaaaagcatttgactttggggttacttttcatggtagagtcaggacaatttctattaaatgctcatacaaataggaagtgcatgtttctccactgtgttcggaagactgcgaacaacagaccttccatgaatatcccaggtagtgccttgggaagaaagctctttgtccattttgtgcacacacttccctctttacctctccagattcacttcttgtgactgaatggaaaccacagtctttatacgacctgagttcaatgtagtggcttttcgctttttcttccaggactttgtaattttgtatatctttttgttctctggacacttaagatactcttcctgatccaaagatcaggagtcgaccacgtacttttaggctggtctcggctgacttgcctctagtcaattaacattttcctttgtctccgcatccaccatctttaaggacttccactccactttcctcatgtcataaacttttctaaaactgcttccataataacatagagtgcaggttctggggccaggttgcttgggtttgaattctagttagctgggtgaccttggacaagttatttactatctctgtgctcagtttcctcttctataaaaaggagacgatagtagtatttttcttatagagttgttatgatgattaaatgttaatcatcttaagaactttgtttttatttaagttgggtcccataaaagtttatgacataggtactgaatagacattttttaaactaatgataaaataccattttcacctaataatttgtcaattttataaaagattgaaaatatctagtgctggtgggtaggtgggcactgctggcaggagtataattggtacagccttcatgtacaatatgaaatgcaccacaaggctcagtactccatatataggtaagcatcattctggaatgtttatagcaacaggatgaatatttattgcatgccttactgaagagcatggggacatctagattgcatgcgtgtcacacgcaggtcatgaggagccaggaccgctacttgatcactcttcagccacttcccaccattacttttgtgccatcacacatgcaccatgttggagccaatgctgagttcaaagatagagtcctctcgaacacctagaggttctgacacgaatatgcccattactttctagttcctcattttcctttggatagtcctgtagaatcacctccttttctcaagggttgggtaggtccttgagggtacagagaagaagatcctggcaatcacttcactgatctactccaagtatccttataatactctctaacactgttttgctgtagattcaagaaagtcatttggaggtcaaatctaagaggctttgttctgtgtggtaacttcctgggtaagaagcctcagctttggatatggttgattaaagcagatttaaagatgaaatgaaaacacacttatttaatatgccaccattactgttccccttaaaatataaagggaaatacactaagtaaacttcttgttcattgttattttcaactccacacgtaacttgaggaacttttcatgaaaaccttccttcccctgcaactcctggacctggggagtggtttcattagttatgctaatgaggcacatgttcagttagctttgtttgtgaatccttgtgcatgttaatatgtcatatttctatatcttttgaaaataggattccaaatatgttcaacggtcttttcagcaaaaaatttacttcctttttaaaacagtttattggaaaacacatattttctatcttccgttttatgctgttgcaggtcctacattgaatggaaagtttgtttcaaaataattccattaattaacagagagccttgatcactggttaaattgtgatttatctgcttttgttcacatctagatttgctacagcccttgcattactggctttctgcccatcagtattacctcaagatgatttaaagcaaaggctttctggttaaaatgtgatgaaggctaaaatcaaaatggcaaagagccggggagcacttcaggtggaacgtaagttcacttatgaggtaaagcactcatgtaaggtgagtggccataccctggtgttcaactcagcttgaattttagctgaataattctgtgcagctccattggttacttaatgtagttatgaaaatgtatttgccctttggtcttcgacattccccacacatgtcttagagtgcttaacattctttctgttcttttcaggggaaaaatttactttttcttttttactgttgcttatagaatattttgagtgatttttttttactttaaaaaatatgataaactttatggtgagaacatatgatttactatgccaagctgttttgttgatttagcttccagatgagcacaaaaataaaaggcagaagtgaatagtttagatcagagagtagatattacaaaccaaatgacaaatataactcctgaaaaatatgaaatgcagtggttaaaattaaatttagacctaattcccttgggaattagctgtatgtagaacattgtatatagaacattgagataatctttggcataaaaagattgtctcattgtaatcaatccagtggaaaaggaaaagtaagatggcccttactcagccatctttctctgtgagcacacaggccattcatagaacaaacattgctttcagccagcagctactggggtcagagtgagtcgtctccatgactatgtgtgcatcctttggctacaggcacttgccatctgataatgaaaactctgactaatttttactttttttttaataatgaaaaactttttcaggaatactttaaaaaggtgagtgtaaatattttaagtttgttgacaaacgtttttactgaggtggatactgctattatttccctatttttcccgaagagtaactcattttttaatgtttgggtgaaacaagtttattttattttattttattttattttattttattttattttattttattttatttattttattttattttattttttgagagagagttttgctcttattgcccaggctggagtacaatggcatgatcttggctcactgcaacctccacttcctggtttcaaacgattctcctgcctcagcctcctgagtagctgtgattacaggcacccgccaccaggctcagctaattttctgtatttttagtagagacggggtttcaccatgttggccagtctagtctcaaactcctgacctcagatgatctgcccgcctcggcctcccaaagtgctgggattacaggcgtgagccaccatgcttggcctgaaacaaattattaacaactgttaaatattatgcaatatgtaatattatatatatgtatgtatgtgtacattgatatatatgtatatatgcatagatatgtgtcatgtaatatacacatatgtaccatacattttatatatgtaatatataatacatatatgtttattatatatgtaatatataatacatatatgtgtgtattatatattttatatatgtaatctataatacgtatgtattatatactttgtatatgtaatctataataaatatgtattatatattttatatatgtaacataatatatgtattatattttatatataataaatatcttacatatatttacatataattacatatgtaatgtatttaaatacgttagaaatatattttacatatataaaatacatatgtaatatattttagagatttttaatatagttgagaacattagcttcttgaggtttgagatcaggcctgaatcttgcctgcctaacagtaagcagtgacaatttgaagggatcgatttcagacctaaaatacaaaaaggaatctaaggggaagaacatttaaaatgtctcctgtccgtatctatctattgatttatctgtttctctctctctctctcaccatctgtccatctatttggattcaccagaggatgaaaaggatcatctttatgagcatcttgcagtgagctgggaggacacatgctggcttgtgcctaccatcttctacatcttaacttaattctgaagcatgaatttgacctgaaaggaggctcaagctttattcttttttttttttcaaccagaaacacaatagaatttatttcctttctttttactgagggagaaacagtgtcctggtaggggaatagtattttcaaaagctgcctaagtgtctttaaaaacaagaggacaactgaattgtaagtgctgccttttctctaaataaacttcatccagtcagcacatcacacactgatattcacattcgattatatttcttaccatcagaatatttctttgcctgaaaaattgtttccatatttactacctccagatcctcccctaggaatgaggtatagtctgtcagtaggtctgtggctctatacattttccattctctttgaagtttgtaggacagaggtcagggttagctttacattctctctcctctttgaaggttgtagagcagaggtcaggcttagcttgctagtcactgcaaattccctttattctcataatatgctgtgctaagtgttaatgataacatgggacaccaaggatatttcacctaatgactttttttccccctctcattattccatatttgaaattaaccaagtattaaaattaggcacctttttccccaggtaaagatgtttttcaattcccatctctaattttaaagtgtgtcattaggttaaaaaaaaaacaagataaaattgtggtaattatattataaactattttggtgaggagaagtaataattcaataattccacttaggagaccagaggttgttattaaaaatgatctgtaggcaaagagagagaaacaaatgggaccatcatcagcaaaaaacaacagaaacacaaaaactgattatatcaacgtgcggtagggaaaaagtgtgacagaatctacaaaatgagaaatgaataaacaggctcaaattttcaagtggatgcttttagagacatatacttgatgggcgtgcagaactcaggcataaaaatgcctgacagaatgataattgtttcatgttaattttgagttaaattttaaaatgtgagttgcaaagtttaatcacataagtctcaaagagctgtttatagaattaggtgacttagtatttgcaaaatattcagaagagtgtttgtcacataataagcaccatgtgagttcccttctattattttcatctcagttggtccttgcacaattctgtgaggtggatactgctattattcccctttcaggtgcatcttagaaggttaagtcacttgcttggacaaactacgtgtccctactgaatatcgcattggtgggaactatcattaaggtgaccgtcctctggccaaggggtgggctgcagcagaggctggtctcctcagatgtactctcccttgattttgaattttattttattttatttatttattttgagacagactcttactctgttgcttaggctggagtgcagtggtgcgatcttggctcactgcaacctctgcctcccaggttcaagtgattttcctgcctcagcctcccaagtagctgggattgcagatgcatgccatcatgcccggctaatttttgtatttttggtagaaacgggattttgccatgttggccaggctgatctcaaactcctgacctcaggtgatctgcccatctcagcctcccaaagtgctgggattaccggtgtaagccactgcgcacggccttgattttgaattttaagtggtgatgacaactgttggaatgtatctctctagagaatgatctggatctcagggacacacacccatttctgtggtttctgaatgtggttctggagaatttattttgatccttgagctactccataactttccattcagttgtttccgttgtgactttggttctgcatggctctgtgcttgggtgaggggatgtggtatatgagggaggaaaatgaccgtgccttgtcatagtcatccgtgctgtgacctgagctggcctagaaaagctaaagttgtagaaaccttggtcatgggaaaggagggattcaaatggccccagtacaaacatggcatctaacttctctagtagaataaaatcatggtgataaaggtgggctcaaatgtttttcatttaattattttacatcatcagattcatgattacctggaggtctgaagtattatgaagtgcccatgttcatctagtcatttttttttgttcatttttatatgactatatgaccactcttttggaaatctggtttctgtttcctctgattgatactaaatattatcaacttcttaaaagaaggaaccacagatttttttccacccaccgtgacctgtcatatgtagctccactaggttttccaattattctgactattctctaccaggttcagtcattctcctgccattcttttccccccctagatgtttgctcatgctgtttctctcacttgaaatgctctttctcacccactttatctttgaaaatcctataccatcttcaaatctcaagtggcccaacttcctcatatgtcaatttatgttgatttctctctgaattcccatggcacttacaatcagtacttcacagtatagtagttattttgtgtgagtatttagctgaatggtaaggttcacataaacagtgatcagttgtttttccccaatattttattgtcaaacattttaaacatacggaaaagttaaagggatttcacagtgtaaacagtcatgtatctacctagatcctacaattaacattttgctgtatttgattaacattttgctatatttgcactatcacatatatatccctctattcatccatctcttcaccttattttctgtttaaattgcaaaataagttgcagagatgagcacatttcactgtatgctaaggcatactttagcatgcttatcactacagttaatatttttaatattttggtgattaacttttctatactccatagcacccagcagagtactgaccacatcatacatgttcaattctttcccattggattgaatttaggtaccactttgaaaagcattagaaactaaaggtgtttaagcccagatgagtggtctctggtggcttagaggcagatagaggtgggtgtgttttacagacttttggaaaagacatccctgtatgtagcttgtattagcccaacttgtgacctctcaaatatatcctaggagtgtgttcaggcaaagtctaaggaggcacttggcggagaaactagacagggcaccatctgattgactaaaatactaagaacattgatattgcagaaacaacagatggatattctagtttttctgaagacagatagaaatgaggttataaaatagtcataaaaacggggttcatgtgcagcagcctgtgacagcctgttccattgcacccaggtgggtggaaattcaactccttacagagccagcacacactccaggtagacaatttgggcccaggcagacgatgaatttgcaagaaggctgctctcctgaacctgtgtaggcagtgagtttctgacatcttattaggggaaagaaagtcacagtacttctcagatttggtaacactttttaaaacatgttattatagcagtcattattcaccctgccttctttctttaacagagatatatttatgttcatatccacatccacatacattccttcattcttcaaatgacaggcttcttctcatccaagtatctctgatcatcccctctttggaattctctcctgactcttttattgaatccctcccaccccctgccattatgttgtatctctgaattctattttacctgggacatttttcaaaatgactaactatatacttgtttacttgtttcttacatttgtcttagtaggctaaaatttcataatgtcagaaacacatttttcccttctcctcttaactagagggtcttatagtacctgactcatagtagactcctaattaaaatgtactgaatcatgtatactgaaaatacatgaatagggaaaaaatttgtttcagtgttatcctaaatgcccttactgtgttaaactctcaccctggctcttttctttctttctttcctagtactgggggctgtactcaaacttgactttctgggcagtgccacaagttacaaaatcattcactccatctctgcaaacttccattccttcagcatgctgctctctcagctaggggttaggagaaaattatatctgatggaagcaattgaccacaagctgtgaatgattgggaactttgcttaatgtgttaaatctcttgaggatgtttacatattatgaaagtggtaaaatctggcagtatgactaagcaacttaaataatttaaggcagtttatgttaaaaagacatacggacttagctggctaaaatcacaatctgaatgatctgaatattgagaaaagtgaattcattcttgtttgagcatattataatctcacttttgttatgcatttttatattataaggggaatactgaattccattgtctctgatagattatctggtagctgatacgttgaatgatgaatgtagggaatagttaggaaggtgaggatttcccaagtcatgttgttgaaaatgggttaggagctgggagtattttgtttatagaaaaaacacagggaagataacaaaacttgcttcattcatttgagaaatatctattaaacacatactgtatactagcactacattaagtgctgtggagaaatagtgattaaaaacattagtcctgcttgcatagagtttatatttcatgattaggaaattgttaaggacagttaagtagaaacaggaagataaatttatagagttatatgtgtcctttctttttttcttagaagaacaggtagaggactaatgcacacaaaattgcaaggaaaaatacctttccttaatgtaaacaaatccctaacatgtacagggtctatcaatgtagaacggaataggatgcttcctggaatagcaatttcccattactgttaaaatttagctaatactatcaagctttaaggtgattttagataaatcccatatgcattagggataagaatagtgacttgcccatagttttttaaaattaagattctgtgatctttgtgttagtcaagatcactaattttcacttatgatgaccagataaatgagcatgattgttcttataaacagaagtcttccaggtcaggtttgaaaaagaggagttatttgatttggatttcttgatcctttcacaaagaaaagagtcaggtgttctgaaggcctggcataatgaacaaacaactgatagctcttttctttatatataataggaagtaaaacacaggtcacagagaggggaaagataaaggtagccatatgtcacctataataatagatataaaagatgggtgcaggggaaagagtgccaaatgttcatctagttgttctaactttctcattttgtccttgagtcatgtggctccatgcaagtctcctttcttctcaggcatgaagtttcttcatcagaaaaatgaggggattgaactacattattgttaatgtaacttttcaatcttacatttaaatattttagaaaaaagtaaacatattttgtgacaacacttcttaattattttcgaccattaaaatagtatagaaataaaatttgctattttctcagtggatcagttagagtcatcaaatgtaataaaaaaatcactcctcttattcctgagcctaggaataaacccagcaatgaaaactttttaattaagcacttagacatacttttgagcaactcacatgtggtattttaaagcaactgtttgctcaaataataattagtaatcttggttgagaaaaatctgaaaactagcatatcaacttgcatcagtcttttaattagaaataaatattcattttagtataacatacctccttgtattagatagaaggggaatgtgctaaactttcctgcatttatggaatttgtctacaatagaactataattgatccatgtaattttctaagatgaaaaaaatattttctaaacactttttaaacagtacttaccaattatagcctaacaatttttaagtaatagaatgttatggcttgatatggtttggctctgtgtctccacctgaatctcatcctgaattgtaataatcctcacgtgttaagggcgggaccaggtggaggtaattgaatcatggcggtggtttctcccatgttgttctctgatagtgagtaagtctcgcggggtctgatggttttataagcgtctggcatttccccacttgcactcattctctcttctgccaccctgcgaagaggtgccttctgccatgactgtaagtttgctgaggacttccccagccatgccgaactgtgagtcaattaaatctctgttctttataaattacccagtttcaggtatttcttcacagcagcgtgagaacagactaatacatggcttttttcataatggcaaatacattaaaatttttgatttataataagtatagcagcatataataatttataaacaactttaaaatatgtttaaatttatcatacatattttgtgggataagtaaaaataactttttctaccccctttttttgaaattccagagtttatagatgacataccaattgcatgtttctttcaatatattatcaaaattagaataaaacttttgctaaattttattgtgtgaaatttctaatagaaaaatggcagtcatataagtgaaactagaaaataaaagttttagattttatacatttttaatttttattacagttgagcttccaaaattatgttcagtaattttataaagcatattttagaattaaaaacataagaaaattttgaatatttcttaaggttttcatgaaatgtaaattataagagattttaacttcatttgttgcctgtaatatagaccatgcaatattgagtagtgattagagttagactctggattcaaatttcttgactttgaaaacttctgtgtgatttttcagtgtcctctggcttatgtgcctcaatgttgtcttctttaaaataagtataatagtaactcactgggtggatattagaaataataattaaatacaggtgtaaataattaactacaggtgaagaccaagaagtatgcttagacaatagtaagagcttaattagtgatagctattttatcattaatataatttaggcattttctttaagaaaaaacttagaatgaacagcctctccatttaaccttgaaggccctctactaatgccatttccttttttgcaacttttagagttctcattaggtttgagccaattttctaatttcttgtatgagcattttatttgtatatttgcatgtggcaaacctactgcaaataatctctctataaagctaaatttccatggcctttacatacttaactaatcccttttagtaagatttctatggtgaagtctgtataattgattttcttctgactataacatttcaacccttatatacttgtttatattgtgttgatttagtttcacatgtggccttagggattatctctaataaatacatactttattcctagcattcttatagtagtttacatgagtgaaaaggaagagatcctgtaccatttatggtttgattttggagatgagataacaaaaaatcaatagaaaaatcctttacaagacatgagcatgctgggaattgacagcaaaggagttgagtatgagttgggaccagtctaggctagctttcagaaggtgaatggcttgcagaaagcataaggtacaatttcatagaaaaaaaacccagaatatttaggaaggagctgtattactagctacaatgcatgtggtaggaaaatgtaggactctgtttgggacagtagagattatggcttcaatggagtggcaagcccatgagacttgggtattagaggaggataaaggtggaaggagctgagaaaaaagcttgattataagacacatgatttgttcataaaatgataaatgatggagaaaggggaggttttctattgttgatttgatttgagagtgacctcatttaaagaatatttcaggaatgagttgtatagcatggttaaatataagggctctagagtaaaatggcctaggtagtaaccctgtttcaattagttatagttgaatgactttagataattacctaatttccttaagtcccagtttcctcacttcttaaatgagtatcagaaaaataactaccccttaaagatattataaagaataagtgagatagtgtataaaaatatttcatggtggctgtcacataagtgcaaaataaatatgtattacatagctattaatggacatgaagaaatgactaaatgagattactgtaatgcaagtgaagttttcagcacatgctttaaacgtaacaggcccaaaacttaacagacacttatttatccacctcacaatcatctggacagttttctttcctaatgtcatggaaacagatctgcttactgtagtacagatgagaggcatgaccctcctggagcttggcctcttacagctccaggactatcactttcccatttatgaagctgcaaaggaagacaagcctaacaagcaagaaccttcaaagacatttgccccagaggatagtggattagtcactctgctaactgcctaattatgaagtgtttttaataagatgctgtaaaataaaaagtagtgagcatttttttttctagtcctacagcagcaatagaagaaataggtgtatgtgtgtgtgaaaaaccataacaataatactttcgtttgagggatacttgatgttttttaaagcactttcgtatacatgatattcacagaagcctatatagcagaaaaatgagtgttattatctttgtttcaaaaaagaaacatgtaagatcctttgtagttatacaaagagtgctttgcttcctcacttccccactcgcaggattctgccttttacgtgtcctgtgccttcattttgaagcagaatgaatctataaagattccttcttttgttctatacccaggtataccctacttgggctgtgctgtatgttctaatgatatatcagtgagtggcattatttggagttacatgtgtccctgctgatgcacatctatacaattagaattttgtggttttggtatgatgagtatttagctgttcttctgaagcgtcactgtttctttgggtcactcctcgtaagaaacagtagaacacagagaacagtcgctaacacagggaatttagctccctggttactatggcagggcgatagtgggtgtggggatacctgcctagtttatctaaaaacattgcttacgtgtaagtcaaacccaaatgtctcaggcttcttcagccagtaagtgcggattgtagccatcagcctcaatcagttacggtgaatactgtggtatgctgcccagaggcccctcgggatgagggggatgcaaaggcctggtcctcttgactaaattaaggaaaatatgaacatctcaagtccagactccccttacagacagctgaggcctctggtgcaactactttgcaattcaacttttgcctctgttcgctcctgtttccctcactgccttccaagtatttgttactaagagcattctctaataaactttgtgcatgcaaatctccatggcacagactgtttccaaggaatttgacctaagatgcagttattaagtttcaggggctgagaatacacactcttaacttcaggaattacaatccattatagactctccctctccaaagatttttagaaatcctcaggacttgtttgcacatgtgtgccaagtatcagattcgcctgttggtgatttctgtgcatcatcaatccaagactttactttttcctattctgagaatacattcctattacattcctacatttcctattctaagaattctatataatcccattctaagaggctacaccaaactggaactgtgtttctattactttccctgaggctaaggtgccagacgaattgggattctccttcaacctaatttctgctactgcaccctagtgaaagggatgagtgacactgctattaccacgcaaacaggagaatgttcctttggtattttattccttgggtagaggggaagggattctcagggcatggttgagtctatcttgtccattgcatttgactggaaatttttgcacttcaaatggtgggagctgtacttaggtgtctaaccagcccctatgtagatcagcagatgccactgggtactgtgaacataatgtcatcatgaggcacagtaaattcctgttttatggtaattggtatagggctttgtcctgcaatctcctcctttttatctttgtaacattttgtctttgaagggcaggatggagttctgatattactggcaattagaattaggccagctaatagaaagttaaaaagtaagagggaccaggacagaattctatctcaaatagcataaaacagaaatttactgtgtcttatgatggcattagaataaattatctgaagaaatgttaaaagtctttgttctatatttattgagttcaaacactttggctcaataccagtacctgtctatggaacaggctttcaattttaaagaaaattggtaaatcttttaaaaagcattaaattactcttaactgaatagtgttgggtggaaaagagttcagatgttaaattgtaaaacaatttatatcaacatatacctacattttattcatatattgatgaagcatgagcaacttgttgaggaggaatctggcatagcttcctttagcttcatttataaagtaaggttttttttttttttttaaaaatagaatggtctcaaatgtgtttttattaacaatgatgctctgttattataatccaccttcacatataacaatttcaatttttcaaaagcaaggtttacttttggaattatgcatttccaaaacaatagctttctaacatttcatttttaaaaagtaaacttttggaaagaatgccagagctactatccaaagagagatgtctgattagaagtttatgaattaaccactgtctaattgttaaacaagtatgctgtttgtctgtttagctcatatacctttcacagtaattataaaccactaataagtaaaaattatttgaatttcataagctattttaatttttattcttatttcacactcaaaaatcaaacatattactttcatatattagcatactttaatatttaagttcaaagacagctaatttttgaatctgtttgtttttcctttgagacagagtctcactctgtcacccaggctggagtttggtggtacgaccttggctcactgcagcctcaacctcccaggctcagatgatcctcccactgcagtctccaaagcagctgagattataggcatacaccataatacccagctaatttttcgtagagacggggtttcaccatgttgcccaggctggtctcataatcttcctatgttgtgggagagacccagtgggagggttttcctgtgctgttctcatgatagcaaataagtctcaggagatctgatggttttataaaggtcagttcccctgcacatgttgtcttgcctgccaccatgtaagatgtgcctttgctcctccttcaacttctgccatgattgtgaggcctccccagtcatgtggaactgtgagtccattaaacctcttaaaaaaaaaaaaatagaatggtctatattttgagtgaactcagtgagaattattctaaagaagttaattgagaaaaatgtttccaaggattgagctctaccactaagaataggcttcaaaaagtttttcacaataaagtctctttcctgatagtcattttaaggcaggaatcaaatactctctaaccataatgataaattccagttaaggagagctagggggactacagaagtggaaggaaaaatatacaaaatataaatgtattgttaaatcaccacttcatcacttaattaacaaatttcttgatgtttcccctgaatcttacttttcaacatgttaaatcctgttatttaactgtgctatatgccagagtgttctctgacccccatcaattattgctattctgccccaatttttataaatttaatttgcccctaagtcttcatttgtttcaccttactttcttataactgtcaaaatcttgtcttgaaagtggtaaactatacacattttagaattagaaggcttttaagaattgaagtttattttgctgtatactctgccactgcacaaaaataatttaaacttcctcaatagtcttttctgacagtggtagaaatttaccactaattataaaggatgaagaaaatctggagtcttagcatacacagctagtgctcaaaacatttcttgccttttatttttatttgttatcctctgcattagaaatgacagtgtttgatggtgacttactgaagagctaaacatcctttcacctggaactttttgttctcatcatacattttcttccatgagcatgttattatctacaccttgatatctttgcagatcctctttcatctgttgtcccctgataaatttctaatcttcaaaatggagttcatttttcattttatattatagatgtacttgccacctgtccctttctcttcagtagggtctttgtggttgctctcagaacttgagggtcaaccagttctctgtcatctcatcttggcatttggtaagatgaggatttgggccctaagtcttgactttttaaattttgctaattgccattctgttttgacaatttgaagtgaattgcacaattaaaaggcacaaatgtgattacagagtcaagtcacttcaaatatgttttttaaacatcaaactggctggtagagtccactggcatattattccataaagatactctgtagactcaggttcacattcagactgagatgctccaccttatttatttttgaatcaataaacaccaaactaatacttccacgtttctcaagaagtgggcaaattttagagacaactttatatagtagaacattctatccaataatccaaaatagtactaaaattaccaacttacagattcatagatatcttttaaagattttcttaagcttatgtaataaaagaaattttagttttacagtagatcttcacaatttaatacaaataaactgcattgtaacttgctattcagctagtttttatgtatgctatgtacagacaggctatgcatggataaaggtgcaagagtaatgtttagctttatatatttacacacatgccaatataatgataaagtattacctatatttctcatattgagcttgagttttcctgcatttcctctaagaaataccagatggaagagctgataaaaagatacacaaattaatattgaagtgatgaagtttgacctttttaatatgaaaatcttgccaaactttccatattgacatggcaacattttatgaataaatctaatatcttatagatttagcacaattcaaaagtcaccatctgtttcaagaagtgaaggctctcacatagtttcctggctctaagactaccagcatgcaatccatagcttatataatattaactaccaggaacatgtgaaaagtttttatatattttagaaaattagaaacataggtaacatttttaattactgtcaaaattatagataatagagtatggatattcttttttcttaaatgaaattgaatggtctcttgctcattctccatattgagttataggtcaataccatctggtcaagcaagctgcaatgcagaggatatatgtggggaaagggcagataactggaatctgatgttgagcagaggtgtctgagagcctttaacaaattaaatatgggtattataagaagtagtctattttctataaattacttactaatatcttaatttgatatgaccaaaatcaatcctactcagaatcattcttcccattttgtgaagttaatgcggattttgcattacaataaatttctttcttaaacaactgtgagaaatgagctaattaaaatgaattttaaaaaatctgcaccaatttacatatataatatgtatgaggttttatcccatagacatggagacgtcaacaggagataaaaattagtccttttataaaacttagcagtttttattttgttttctgaaccaaatattatcaaaggtaatgtgataaatatgtctacaatgatttcacttgacatatgtttgggttttagcaaatactaataagggttcttgctgcccaactattagaaacttttccagcctctgtccagatgatcttaaaccatgcatttctttacaccgagctattaaaaagtggctattggagatgtgttgctctggcagtaatacagttcttggccaacatcccactttggctaccctaagagtttgctaaccaaaataaattattaggtattagggtgtaccttcaatagacatggataactttatacctctggataaatctttgaggaaatgttctcaggagtgttagtagcatctaaggaagggggaataggctatgtgcctttaaaacatgcagataacacagtaaatcacctagaataaaggacacagggcttttttagagaatagaatactgggtaaaagttagcttttgtgtaaaacagacactaaaggtgccagaaaattttaaacttcagaaacttaaaaaagtgtatatatatagtaagacaatttttctgaacttccccaaaagagaataacccttgtgaaaaccaatagctctctctatgtgatccctttcaaaattcgctgaaatgaaagacaaactgtgcatgagtatgaattacagtgtacctgtagaactgtgatctctgctccatttcatttaagaagaacttctaccttgatactgaattgacctcagtcactacaagtggcttattcaagtttgttctacttctcccttctgtcctacagatgtaagatagatttagttggaggaagtactggctaataacagaataaaaaataatagctaataacaaaaaataaagccatattttacaagttgggcttatggtttattaatttttgaaaataagtttttattaggctgggcatggtggatcatgcctgtaatcccagtactttaggagggccgtggagggtggatcacctgaggtcaggagttcaagaccagcctggccaacatggagaaacctgttctctactaaaaatacaaaagttagccaggtgtggggacgcacgcctgtaatcccagctatttgggtggctgaggcaggagaatcacttgaacctggaagttggaggttgcagtgggagcgtgggcaacagagcgagactctttcaaaaaaaaaaaaaagtttttagccatcatgctattttttttattgtcaagaaatactttaatattgaagacatcgtgtcaacattcatatgatgaaaaaggaacctaactcacatgctttttagggagaaatttaccctgcatttgcatagtgagagttttgttagtgagaattaagttggaaaaagccgtaccaaaagacctttaaattctaaattttgcccagttaatgatgaagtaagactaaacagatgagacagcaagagaaggtgacataaacaactggacagataaagcaaaggcaatcgtaaatccagggacatccacaatgacaggaatcagaagcctcaagctatgtatctctattttccctgccctctggcaggaatcttctctcatgtacattgtatcttactggcctaaacttttaagaaacttatgttctcagccaggcttggtggctcacacctgtaatcccaacactttgggaggctgaggtgggaagatcacctgaggtcaggagatcaagaccaacctggccaacatggcaaaaccccctctctactaaaaacacaaaaattagccaggcgtggtggtgggcacctgtaatcccagctgcttggaggctgaggccggaaaatcgcttgaaccctggaggtggaggttgcagtgagccgagatcgcaccattgcactccaacctgggggacaagagcagaactccaactcaaaaaaaaaaaaaaaaaaagaagaagaaacttatgttctccctttttcatcagttttctatgtattaacaatttctactcaactggtaattccaattaattaaacacactgaaatttctttcatgttacatttttttctcttgattcctcactttacctctttttatacttccaaattaaaacttcaaagagttgtatatacatattaccttgatttttctctaatcgggcttcttcctctatcctgctacactgaagtcttcaggtcatggaatcatgtggacagtccagtggactggagcattcgataaactttgccattgccttccatgacactctactccttttttggctgttacttcctacttactccttgtcagactcttttatgatttcatctttcagtatacagttattaaatgttagctcatcaagagtcattctaggcaatttttttctactgtatactctcatcctttcccatggtttcaattatcgtctgcacagtgatgactcatgaattcatattttccaaccagatcccttctctgacctttacttccatatattcaatggaaaattccactttgtatttcaaaggcaccttaatctcagcatgcttaaacttaaactcacgatcttctcaatctaacctgctcttcttgcattgtttattattatctctgtggatgatctgctatccaattgcacataaggaaatgaatattagtttttgacacctctattttcactcctagtatttaatgagtcattttgctcctaattatgtcataaatatgtcactttagtccaagccaccattatatcttacttggatatacagtaaccctctaactggcttcctcaattattccttaacatagctgcaaggccagacagcatttgcaaactgtctacctttcaaactttgtttttcattactaaggcaccctcttctgcttctctgttcaaaacacgctgttctttgcggtctctgaatctgtatatgccatggttttttctagcatagggttttgttttattgatagattgattgattgagtcttgctctgatcccaaggctggagtgcagtggcaggatctcggctcactgcaacctctgcctcctgggttcaaaggggattctcccgcctcagcctcctgagtagctgggattacaggcacgtgccaccatgcctaatttttttgtatttttagtagagatggggtttcaccatgttggccaggctggtcttgaactcctgacctcaggtgatccagccacctcccaaatggttttttcatgtactcttcccttgcctgaaactcataaccactgctttgcctgtgttttcttttactaagtttatctctattcatttttaaagctctttggtctctctagcacaggctaggttacttttttaagccttcctgcatcatgtttctttcattaacaacatatctcaaattattcctttattagtgtgtctacttgtcagtcaccctcactaaaccatatacacataagaattagtttttttttctgttttggcttaccattgaattctagtagcttagtatagtgctacaagtagagtaagaaacatttgttaaatgaatatatgaaactaaatatagaacaaaaccaggagaaacagaaaaatgagatgcaaatattaagacatcgagagcatgcttagcagatgagcactcaacagttttaaattaatgatatataatatgtaatatatagtcctagggtcagcctactctcactttgagctcttgtaggctattgcctataacacagagcagatttgcatttttacattcatagggatatctcctttttactttcttaagttttgataaaattaatctaaacacttggaaagtccttttcagttttactggaagcatcaatatttattttacaggttgtttttttcctgaggctatctcagaatctgaatggtttgaggactgctctattaagttattacttaaaagtaaagaagaaaatcatttctctaagaatttaacccccgaatagcaattatttcatgtataactgaaagtactattgtttgtataaattgttgacattgtataaaatgatgttcttattaatagaaatgccttttaaacagttttctgttatttagcttctcatctggttctttttagtgatcaacagcaaacacttagaaatggttgaaatatttgtctgttgctctgaaggagtttgttttgtctgtatagaactcagtgttgcaaagggtatacgtaatttacaaataatgatttcattaccttagagtaatttcattgccttcttgttataagcaaatgaattgcccagcccagacaccctcatttcttcattcattcagacatttactgagtatctcctatttgtcagatgccctgttaagtgcattaaaaatgagtaagaaaccatctctgcctgtaagaagtttcattttcagattggtgtccattttgttgatgtgattttcagactgatgcagtttcagagaaagtttatttgatttatataaacttcataggttagccaagattcctgctgatcagactaacttatctaattgtcattttaaagacgaactcagtcacagaatatttttcaatgacatagagtaactttggagaccattattactatatgaaaaatttgagctatactgatgaaaaattttgaattcttagttgctgcatgtaaattttgtttagtaatgcccctgagatgtgatcatcatttagcaatttctcttttctgatgttttataattttgaagcataaatgaattcaaagactgatttccaaaaatttatataatccagaaagacatttccgtttaacattctgttggttttggtttttcttttctactgagttttctttttttgtgcagtcaatggctcccactaaccaattcctagcagctgtactccatagatattttgttgaacaataaaactggatgttagttttaactgaacaacttgatgctttaatttatttgcttgcaccataatattttcaaataaaattgatttactctgtgtgcaatttgattcccataggatagtattaaattatagcttagttcaatttgtagttcattccaccaaattataaaaataagtaaaacaaaagcaaaaataaaaaagtaaacaaaacaattttcagatggacttttaaaattcttttcacttttgggtggctgttacacacgtaaataacatttaaaaaatagagttcaggccgggcatggtggctcatgcccgtaatcccaagactttggtaggcctaggaggatgaatcatgaggtcaggagtttgagaccagcctggccggcatggtgaaaccccatctctactaaaacaaacaaacaacaacaacaaaaaactagccaggcgtggtggtgcacatctgtagtcccaactacttggggaggttgaggcaggagaatcgcttgaacccgggaggcggaggttgtagtgagctgagatcacaccactgcgctccagactgggtgacagagcaagactccatctcaaaacaaacgaacaaacaaaatttcagcacgaaagaactaccgtggagtacagtacttaccgtattgtgataggggtgaatgcatttgtgttaatgctgtaattagcagaaacagtcaaaatattttgagaatttccacacccatatttaactgatggccttccttccacaagaaataaatgaagaaactgctttccacaattattcccattacctttaagaaaaaaagaatatattagtaattattgtagatttatattttattggttaacaataattaaacacaatctttgccatcaaagactaatgatttagggggttggtaggagtgctattagataattattcagtgtaataagtaccatattagaaacgtacattattgtccacaggctgaggatagcatggtattaacagcattaacttgacatgaattttaacttttgattctgttacctagtagctagatgtccttaactattttaaacctgtttccccatatgttaaaatggggtagtgagagtaactactgtgagtattagaactcctgtgataattaaataaaataataaatgaaaagtgccatgttgagtttttaataacttgtattattattgaatctaatgtttaaattttatttttgatttctaatttcttatgtttatttgtattttaattacaaaggaatatgcatcttctatcaaaataatagagaaatatatagagaaaagagataaatatttcttttccccaatctcattcttcatccccactttgaaatgttcttttctaccacctatctccccacatacaaatatttacatatcccaattttatttttaaaaatgagatcatactttattcataaattcataaatggcttcattcatctttctctttttgcttaaaatttggacatctgtccctggaagcccatggatctctctttttaactttcctaattgaagtataacttgtacagaaaatcacagaaattataagcataaagctcagtaagtaatcacaaagtgaacccgctcacctaaacatcacccaaattaaggaaaggaccatcatctgcattgtcagaagtcctaccaatcactattcttttctgctcttcatcaaaagtaaccactatcttgatgtttaacagctatagttagttttacttgattttaatcttcctattagtggaatcatattgtatggattctttaagtctactgtagtcttccctttatgacagtcccaaaacaggtaattacagtacaataaaatatcttgagagaccatattcacataatttttattacaggatatagttataatcattctattttattatgtgttggtgttaatgtcctacttttactaatttacaaattaaactttatcattggcatgatgtacaggaaaaaatcataatactgatagggttcagtactatccacagtttcaggtggatcttggaatgtatcccttgcaaataatgagggactactgcatttgttttggctcaatgttatgtttgagagatagattatgccacagttaattcattatcattgttttgtaataatccattaagttaatatttaaaatttaattactgtttctagtgtagatagacattttccccctaggctttcgttactgtgaaaaatgctgctatgagcattttatatatgtctttcagttaaattgcatacatttctgttgtatatatatctaggagttgaatagctctgtcagaaagtataaatatgattaactttagtagctattgccagttttccaaaataattgtttatatttaacactttaccagcagcatacaagagttccagctgatccatagccttatcatttggtatggtcactttgtagattttacctattctgtttattatagctttaattttactttcttgatattggtgaagttgaacatattctcatgtttactgactgttttgatatactctgttgtgaaatgtcactttgtgtttcttgctcatatttatatttagttgtttcttttttcttattgaatacaagctctttgccaactacatggattgtaaatatcttcttcagttctgtatattgacttgccaatctcaagggtgagttttgatgaatgtaaattcttaattttagtgtaaatcaatttatgtattgtttccttcagagttatgattagtcctttcatgtcatgtttaaatgttgtggggtggggggacgggggagggatagcattaggagatatacctaatgtaaatgacgagttaatgggtgcagcacaccatcgcacatgtaaacatgtgtaacaaacctgcagtttgtgcacatgtaccctagaatttaaagtataataaatatatatatataaaaagaattatttgccttccccaaagtcatgaatttattctacattaccttctgtaagctttacttaagttctacactctacctagaattaatttttctgtgtaagtactgtggagttgtgataagctgaattatgacactcaaagacacccatgtactaattggtggaactggtgagtgttatttgatattgccaaagagactttgcagatgtgattgaattaaggagcttgaaatggagagattatcctatattatctcggtgggccttaaacatagacacaagtgtctttgtaaaagggaggaagagggagacttgatggcagatgaggagaaggccatgtgactacagaaacagagactggagtgatgcagccacaagctacagaatgctgacagccaccagaagctggaagaggcaaggaatggattctctgaagcttccagagggaaccagtcctgctgacagcttgactttagccccataagactcatttcagacttctgacctccagaactgtaaaagaataaatttctattgttttaatggtaacttggtatagcagcaatacaaaataatgcagggatcattttttcattttccattttgatttctaattgatccaaaatcatcaaagtaaataattcttatgatgtaaatattgaattttcagatatttatttgtggaatatatatatattttactatttttgagtttttccattccctacttttcttctattgtttttatcagtatatgtatgtatatacatatcagtatatatacacatgtgatatacatatatcagtatatgtattttatgataatgacattgtttttgtactcaagcaatagaaaaatggacaaataaaagtgtcttaaatctctccaaaattacaaccttcagaaatggccagcattaatattcagtgaacatctgtagatacaaagattgatatatggatagataggtagaatttcttaaaataagagcaggatcacactataaagtatttaaaaaagaaaattatatgaaatgagtggttctcaaactctttgatctaaggaccccttaagacacttaaaatccagtgagaactctaaagagcttttgtttacatgtttcgcatcttttgatttactgaattaccatttaaaaccatgaaaattttcaaatgttaatttaaaaatatcattacatgttaacctaaataacatattttgtgaaaagtaattatatttttttcaaataagaaacagcaagagaattattctatacttttacaaatatctttattttgaaacttaataggagacagctggattattatatctacttctgtgttcaatctgttgtgaattgtttctttggccaaagtataggaagttcagcctcacacaaaatgttatgggaagaggaggaacattttcataactttttcaaatacatacaaactggacaaatggcagttcgttaaagtttagttgcagtgtggaatctaaaagtgtattaatgaacttcacgtccttgttacattaaaatgttattggtctttcttgcactttgaatggatgttttactcagtcataattttataacatcactaattgatcatttgaaaaatattggttcagagttatgcagagttttcagatatgacacatttattgtataataagatatcaaattcattaatattaccactgagataatcagaaaatgttagaaagctctcaagtttgttatggggaatgtagatttttccaaaattctaatttttcttagacagcttgagttttatcggcaaaaaatactattagctgttttccttgaggtaacaggcttactttattactttttcagaaaatagctgccaaatagtcatgtctgaataaccatacattatctgctagtcattttttcagtagttttcatagtgtctagttaaactggcaacttgtctcaaggcaactattatactttaatatgtagtcaactttcttaatgtgtacttccaatgttacagaatattaaaacttgtatacccaagtgttgagatttaataagattattgaattttattgcatctctaaggacatttttttaagtgtccatttttgttttgagtggacagtggaaaagaatacaatgaccgctagtacgatttggtgctgctgccttaatattaaggtgttaataattttattcattatgacttttacaccatgagcgaaaatgtcaacacagtgattttgaccttctggacacttgaaactcctgtggatccctcaggagtctatggatacactcggagtatccctgtgtgagagcttacctccacttaaaaggaaaaaccagaaaccagaatgaaactagacttattgctcaacattaattaagtgtttctttaacaattcagcaagactatgtagaaacctgggttatctgttccccctacctcaggttctagacgagtggattaaaagcaacagtcagggctcaaagaatggttcagagaaaggtgtctggaaaaattatgaaaggctttgaaatgagaaaataatttaatatttagcttactcatccaggttctctgaacctttctttgtctctgagctatttcccaatactgtaagttgcagaaaactaataataattcacatgattcctgactatactaatgcatgttaattttctgatgaaatgaaattattaccccatggggagactatttttttatctacttgtaaatttacttcagaattccttattctttatacatgtttgtgccccttgaattgtttcttgaacttgttataatatctcaccagttactacataaattaataagtaaataaaatctttgacatttttttattactattatactttaacaaagaaaaatcagctaaatcttaaagaataatttttaaaagggtatataaaaacacatgtcatttagcattaggtatatctcctaattaggtatatctcctaattagggatacctcctgatgctaaatgacatgtgtttttatatacccttttaaaaattattctttaacaaagaaaaatcagctaattctagtttttgatgttacaacacatataaggaggaatgatttgtatcatatccaaacaaataaaaccaaaaccaactctgaggaaaatttgcataaaaacagtgcaaatggggtccctgatactagggaacattttactctcgcactggacaaagatgcccacactgaggatgaccaagttggggaaggaaggaagaattcaaaacatggttgaagaaacatatagagccggggggacataaaaaatccaaggcacagaagtacgtttcccattagtgctgcgcttcaagctatagaacttattgagaatataaattcagtatgagagcaacacaaagtaatacataataataaaaatagattaagtcaatattgcagaagtaaggaaacagataaaacaacagcattaaagatttaataatttagaataacaaaaggcatatggttgaaaatcactcatttgagatccttctaaatgtcctattttaggatccacttaacccatctgggtttatcacttctgaggacttcaactgtacaatgagcaaattagcccactgcatggcatagggcaatacaactttatcttttctgcgtcttctgagatccattagcaggttgttttttttttcggcttctactctttagtatttttttcttatttttcccatggcttcctattcagctgatcaggctgcttttatctgaatttgagagtataattaaaatttttttgtattcttgactttttttctggagtggaggtgaggtggtggttgggagttggagcatatttagaaacacaaaactgcaccagcacttgtgtgtttttctccttggatctgtaaaaggttatattataaaatggcataaggcggttcttctttcttgaattgttgacttgttctccactcccatcattttgtgcgtggggagggtgttaatgcactaaaggacagtctgttatcctgctccattctatcgtttctactcagaagctttctatttcttaatatttttcataaactgctttatgttaccatttcagactcatatttttgagataagtcttaaaaataggatatatagtgtagggtagaacagaacagctgagcatttaggtcaagctgttgtgccatatgtacaaggtttgtttttcaaaacttcaaaaactgaattttaaagattgactatacacattcaacaagatgtatgtagtactatgcaagaatgagttatttttaaaggaagctcagccactaacatcaatgacagagatgaatagtcttattcaagtataccaacatcccattatggactgtagctgctttattgtacagtataaaataagactgctttaataaaggtaatgggaacaaaaatgaacaatgaagcttagttctcttcacagtctgctatatattaacaggttttaatttatcatattgatttattccattaacaacaattcgtggttttatataatattttttacaaaggtcaaagtgttttgcaaataacatatgatggtaggtgggaaagtagaggatctgacactactgatgtgtttccatgattctatagcaaattaatcaccttagggaacaaaagacatatcacttgattgacttttttcaccctcaaatcaattgactttgtatcatgtaaccctaggattctataagtagagaaaagctatgaataaacacattcaggaggaactctggtttttccaaacagtattaaagacaattttcaaacacaattatggtaaaaattatttgattttagaagggaaaagttagtggcaattaggaaaagagaaagaaacttgaattttcaaaatacaactactgaagaaaattctaagtaatgactattcttagataaatgtatgtatttttacattaaaccttatggattgagtaatccatatgtcatattaaatttagttcaacattgctcgttgaatgtagacatcaagcaatgtgaatctttatatatatgtgtgtgtgtgtgcatatatatatatatgtttgcaaatatatatagggcaaatgttaaaggcagtgtctggaacatttcccccataatgttctaatttgtgctaccttcaggcaggacttgaaagctctagaagagtttaccattaagtcgttgaaagaaagtcattctattctttcactgaaaagatgcttgatgatccattagagaagtatgaacctatccttttcttgaaatattaagttggtgcagaagtaatgcggtaatagttctttaggcttttaggctttgtagtaagttttaaaatgaatcatttattgattttttttctgaatgttttatccagactacatttcaaaactttataaaatctctagttctcaaattttgtttatcctaataaaatgattgtctgctaatttaagatttgttaagcataaaagtgctgcttagaacaatgaataatagtattcctctcaaaacatagattccagtatctaaatgtcatagtttttagagagataattctaagaagtttgaatctgatatattaaaatatatatgtatatataattagtcttataaaaagaaataatgaaataaatatcacatggagaaacaatgatattctagtcacctattttacaattttagtttgcttagatattagtttaattgtagatctggaatttgctaaacatggatactttatcactttattgaaatattgaagatattcattgtttatatggtaccactcccattaaacatgggtattcttctctaattgagctattgtaataatgctcccaatatcaacaatttgaattgagatcatttataaatattcaaaagaggttcattggttatcggtttgaattaaataaaatctaacatcattccttatagaattaatagttataagtgcagataaagcactattaaatcaggtacctagattattaaatctggaaatttccataaagttacctggatttctatcatctaccttaacagaaaaatacctcacatttttatggtgttttgtatttttcaaaacacttacatagatatacatttcaaaccttgtgaagtttgataatataaacatacctgcatcacttgtagtcaaactaagacatagaaagatgaatagatgtaccctatattgtacaatagctcacactaacttgggttcaaatctatccttggttatctactgacgtttcaatcagggctacctgtgggagcagtcagatgatctgtttatcctggtgctgcttcatgacatatgataaagactgtttggttatcttgcattgagatctctgttggaacacagatgtttcttctgtagttttagaattcctctttcctggttccccctaaaggtctggatttgtatacagcagtaattccagtagcaacctcagcagcagttgctcatgattttaagacagcttacagcaacaatgatgacatgggctgataataaccagtgttagggtaagctagtttgtcagtgggaagatggcagacagagaagctctggggagaactgaaggatcatggcagcagcctggtacataattaatgattacacccatgtttattacatgctattggagattggcttcaggccaatttctgaaatttatagacagcctgttttaattttttctagtctgctaattgtgcctaaccagtaaaaaacactagtaatacacaactcttagaggaaatgggtcttcttcatttgggtgaaatgaataaaaatgaaaactccaaatttcaccaattgtctgttttcctactctcccatttttgatgccacgatttttagtctatttgttgctaggatgaacatggctgttaaatggatataacattcgtaacacctctcagacaaaaatcttgcatcttaagaccttaattccctagacaaggtacaagaggaaaggagttaaagcattatctgaataagtcacttatttcaggcctgccatttgccaagcactgttttatgcaggttatatgtatctctcattgacttatttcttcataaatttcaattgtataagtagaatataattgttctattttaggcgaagtttaatgaatcacataattctaggtcaagggttggcaatctatgtggcccatggaccaaattctgacactgtctgattttgtaaatcttaattgaaacatggccgtactcattcatttacatattgtccatggctgctttcaggctactatggcagagttgaacttgtgcagcttgcaaacatatctacttcaaatatctatttctgagggttatagaaaaacttgccaactcctgctatattcctgattttttaagtaaatgcgtgaaaacattatctttgtttcaagctacattttgactaaaccattgaaatttgtgtttgtttctatttatcagaggaataaattataacaatgttcaatgggataatttcctaaagattcaatacctacttattttttatcacaactatcaaggttgaataactcagaaacaaaacttaagaactattctagccaagtacctatgctatgcaaggcactagaggaggttctgaggagagtggggagaatagagaactacgaaacacagtttcagattaagaggttaatatggtttggctgtgtccctacccaaatttgatcttgaattgtaactcccataattcccatgtgttttgggagggacccggtgggagataactgaatcatgggggcattttccctcatactgttctggtggtagggtataagtctcatgagatctgatggttttataaggagtttccccttttgcttggctgtcattctctctcttgcctgctgtcaagtaagatgtgtcttttgccttctgccatgattgtgagacctccccagccccgtggaactgtgagtccattaaacctcttcttctttataatttacccagtcttgggtatgtctttattagtagtgtaaaaacaggctaatacagaggtgtttgctatttggtgaggagatgtaagcacagactcctggtaaaatgaatctctgtgcaagttcttaatttatacttctaatttaagacatgtcacaaccaggtttcccaaagaattatgtagctatctactaaaaggtgagaaactagggatatatagaccatcacttattcaactttgtatccctcacattgcccaaagaaagctatgcacattttaggcactcagaatttgttgaatttgtctttgctgtcataaaaaagatgaaatacaatgaatagaagtttctcatgaatgacaatgcattaattcagccatccatgtttgcaacttactctttcctatatctgtcttgagctagctctattgggacccattaaggagggatgaagatattcaaagaattttatggtacacacaataaaattgattaaaacaactgagcaatctttttccttagaagagaaaagatgctatctaatatgatgccagggaatgctgtgggacttcattggccttgccacatcattgaaatgaaatatggtaagtgtctaatgaagatgttatatattctgctggaaatcattttatagggaaaggcaggtgttatgactctttagatttcatttgttttctccaggagtatcagaaatcttttagtcttccataaatgcaaatgaagaggccccaataattccactagcatgtcaattactcttatctaagattggtccttcttttgcttcctattttaaatacaaacattaagtaatataaagattgcttctgaatcctctcctcccactggagttgctcatgtaatttgcctcctgggacttggtcagatgtcttctcataattttcaaagatcacatacttccacatggcatgcttatttcttttcaaagaagcagcacagaatggatccaactgcatggtaatatatcccatgacgaagcctcctgattgatactgcttgtgtaatagagctcattttctgaaagtgcacctaaagaattttgtgtggtctcatcccttctctcgtgacctattagtagctcctttgactaggttccagaattctgaattggttcagtggcagattcaaaaagctttcttttcatcttgactgctgctctcagagctgtctctctcccacagagtgttcttttttaagctatcctttctaaggatttttaccgtaaccccgtaaggattcaagttttatcttccttttgttccttttcaacatcaattagttggtgaggcaaactgagacaaaataaatgtgcagttttgaaccaggaatataattcaaagctgacagtggtttatcagcctgatagttctctatccttgtctcttaaatatttgatttgatataaaatacaatgttcaaaaaatgtttgtgaaatggaattgagttgaactgaaatatttaggaattaaaaaatggcaaaattaaaatcaaagcaactcaaacaaaatcaacacctaatatttgaagtgaaacatctgttttaattttctcactagttttaattgctcctacacataatatactgatttcaaagtaaatgcaattatcccctaagttaagggacacaccttttaaattaccagtatctaactgaattacaaaaatctttgtgctcatctgttgtgaggcttttatgaggttgacagattctaagaggatagaaagtagcaacccaggaaacattctgctgaggtattcccaacagtgtaggattaaattaccaccttaaaaatgaacagaaagaatgctttacaaacaaaaatattttctcccttcatgggctctgaaactctctagagtaaacagctttgatgtgtccggtactataacaacaattatataagacaagggcagaaatggataatcgttacagtgggattattttcttaccaataatttctagtttgattgtttttgtaggtcattgaataaggaaggcagaaatgatcctatggcactatcatcagcttgacttttattggatttagattaaagtacgaactttaatggagtgtatatatgcttggcatgtatttctctggccttcaaagataacacatccaagtgttggtatggacatgagccaggagcgtgaacccagagcaggataattcccagtggttgggtgctgctttaactatgagctgtttttagttggtagaaataaattttccccaagaaaatgccttccaattctatataacttaaaaaattgcaaagctagaaaatcacttttctttgtctttcgattattatgtttgtgtcttttgttctgtttttcttttgtttactctgcaatgtactattacttccaaatttcatggtcatctaccagcacttagattttgtataaaaaacaagtttttcttttgtattgtcttctctctctctcttttaacataaatcagtcagacactctctaaagctatcatttaaacatgggtgcctctgctcctggggaataaatgatactggcctagcctggcaagttggtttctttctaaaatataacataaattctttgttttaatttaatgttaaaaactactaacttcacctggctttcctaaatgcttcttttaggcattttactcgtagtcaaataataaaatcttttatgtattttgtttagaaagtgtagaatgatgaatcaatttagcaaactgtttcaaagtagaggagcaaatcgtttgggaaataataagttgccccaaaggggataattgttttttattttttatttttttattattttattataccttaagttctagggtacatgtgcacaacatgcaggtttgttacatatgtatacatgtgccatgttggtgtgctgcacctattaactcgtcatttacattaggtatatctcctaatgctatcgctccccgctcccctgataccacaacaggcccctgtgtgtgatgttccccttcctgtgtccaagtgttctcattgttcaattcccacctatcagaatatgcgatgtttggttttttgtccttgccatagtttgctgagaaggatggtttccagcttcatccatgtcccaacaaaggacatgaactcatcattttttatggctgcatagtgttccatggtttatatgtgccacattttcttaatccagtctatcattgttggacatttgggttggttccaagtctttgctattgtgaatagtgccacaataaatatacgtgttcatgtgtctttatagcagcatgatttataatactttgggtattacccagtaatgggatggctgggtcaaatggtatttctagttctagatccctgaggaatcaccacactgtcttcctcaatggttgaactagtttacagtcccaccaacagtgtaaaaattctccacatcctctccagtacctgttgtttcctgactttttaatgattgccattctaactggtgtgagatggtatctcattgtggttttgatttgcatttctccgatggccagtgatgatgagcattttttcatgtgtcttttggctgcataaatgtcttcttttgagaagtgtctgttcatatccttcacccacttgttgatggggttgtttgttttttttcttgtaaatttgagttctttgtagattctggatattagccctttgtcagatgagtagattgcaaaaattttctcccattctgtaggttgcctgttcactctgatggtagtttcttttgctgtgcagaagctctttagtttaattacatcccattggtcaattttggcttttgttgccattgcttctggtgttttagacatgaagtccttgcccctgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcagatttgtcaaatatcagatagttgtagatatgcggcattatttctgagggctgtgttctgttccattggtctatatctctgttttggtaccagtaccatgctgttttggttactgtagccttgtaggatagtttgaagtcaggtagcgtgatgcctccagctttgttcttttggcttaggattgacttgacaatgtgggctcttttttggttccatatgaactttaaagtagttttttctaattctgtgaagaaagtcattggtgactttatggggatggcagaaagtggccatactgtccaagggataatctgttaaggtactaaagacattacacctccaatatgaggaattgttaaaatgattgtgcatttatttcaaaagagaaaacaattgtcaaattttgaatactgctggtaatacaccttagtgatgttcattcacagaagaaagaagcccatacattctgcttatagagacctttatgagcaaattgcataataatgcagagaactctggatgtaaagacatttccttaagcaaatactgttaatactacttaaaaaaaaaccagcttatatcaagataatagatgttactaaaagagtggtaggaatttacttgattgtcaaatgaaccccagctttggaatgccttttcccaagttatcaagtattgaatgtaattcatatttagtgatttatatcataaaagtatgctctgaaacatttgcagcatttgttttactgctatagccatatgctgtcaaattcatatgcttgctaaattctgtcttgtcagctcagatcctgtttgtaagtcacgttccattgaatgactcataaagaaacttctagagaaactacaaagaactaaaatttctctttggtaatgcttcatgcactggtctggaaaaattctctcacaatatttaaatgaataaatcattgattcaatagatcaacgtttgagaaagaaacatgacatacaagaagtcaaacatttaatactcactgtaaagaatagttccatttaaactgtttgtttttatagtcaagtagatggtaacagttctgttatgttccttctccaggacaaacttcaaaaagggcagttctaaataggaattcccattgaaagatggaaagaataaacctgcatctaaaaaagaaaatggtattaatatgttctgatagcattatattgctactcaagtagataaaaacttagcatttatagttagcattcatttgaaaaggtaacactagtatttaaaatgttaggtccaattttaagaactttagatataaagtgtaataaatttatatttattgcctcaaataattcactaccagtacagaggaaaagactgaataagagttataatttgatgtttatggatgggttttaagacataacaaacactctaaaattgtctgaaaaaaatttgtgtacttgcattgtgaaatcagtgtttcaccagattcttttgcgatattttgtgatgtgaaggttgtattgtttgttaatttttaatttttgtgtttacattgtaggtatatatatttatgggtttcatgagatattttgatacaggaatacaatgtatcataatcacatcagggtcaatggagtatccatcaccttaagcatttatcctttgggttacaaacatcaagatatacacttaaaattgataaattttatttgatgtaattatatgtcaataaagtgaaaaaaattctgtgacacacaaaggttagagaactgtcacacagaggaattttattaatgttcattaatatttagtgcttttcaataatacttagttattttataagtagtattactataatatgcaaggttattagttttagacttatagaattatttgtattttaaataatctcacaaaatcttggtgcacataaaatttaaaacatttcattgttatagatctatattcatatctattaaaatataattggtacatagaacaagtgtaacacatggtatgttgaaaatgcaacttctttaacatttggtaataaaaaaaagaaaatgcaacttcttttttttttttttgagatagtgtctcattttatcagcacaactgaagtgcaatggagcaatctcggctcacttcagcctcaaactctcaggctcaggtcatccatctgcctcagcctctgaagtaattgggactacaggtgtgtgccaacacgcctggctaacttttgtatttttagtagagacagggtttcaccatgttgcccaggattgtctcaaactcctgagctcaagcaatctgcccaccttggcctcccaaagtgctggaattacagatgtgagccaccatgcccagccaactttcttttttgtctttctcacaatggggggaattttctctgccactggacggaaatttagtatttccgattatttttaccatctctctaagtcatacagtgagtgagaaactaatatccagtctaagaaatttagtaacagttaaatcttccatcagagatatgatttctcctatcctccttcaccagcctatctctgtagggtggcctgacacctgctgtcttccttgaggggcagaagtaacctggtttctgttcttctttttatcacctctcctaaggttagctgctgtttctgacccttccagctttgaatggggagaaagtaaggtggggtggaaaggaaagactacacagtaaagaagagctgttagaaatggcaattgtactgttgtaaccaggcatcttgctctttaggaagggaacatgtttaaaactggttgtttctttcatggtagggatgccagataaaatacaggatgctcagttaaattcaaatttcagataaataacaaataagttttttgttgttatttgtttgttttttgagacagtcttgcttcgttgcccaggctggagtgcaatggtgcaatcttggctcactgcaacctccacctcccggcttcaagcgattctcctgcctcagcctcctgagtagctgggattacagtcatgtgccaccatgcctggctaacttttgtatttttagtagagacggggtttcactatgttggccaggctgctctctaactcctgacctcaggtgatccacctgcctcagtctcccaaagtgctgggattacaggcgtgagccactgtgcccagcctaaataagtttttagtataagtatgtctcaaacatcacatgaaatatactaaaaatagtgctgtttatttgaaatttaaatttaagaatcctgtaattttagttgctagatctggcaacactatgactcatgagcatttattcaatctttggaaacctttgtcaactgccacgcctaggatttgcagccataccctgccttctttcttgtcacttctatcttggtcttgctctgatttttcaaactcttgttgttgacagtgatttgcctgtgtcagtgcaaacattgcacagattaagttaagtaggcaaggatgacttttcccaaggctattgcaataagggagaggtcagaactcagtctgagctcaactgctttgtaataaagtaaagggtgggagagtttttaagagctggagtgagagagaacacaggctgtctgtgtttgctaattggctttattcaaaggataagtaaactttctcttatctttgtattaggacatagttttacaactaggaatcaaggcacccattgaagttagtcttataccctcccctagaggtggacagatgggctgctgtcttcttttatgattacattttgggggagcagtggttccaagaaccttaagaaagattcctggctggtaaaactgacaagatctttaaaagatttatgtttcaaaggcaacagagaaataatgtaatacggaaagttttctaaagtaaatgctccaaggacctagtcaggaagaaacctttctaaagtttagttaagctaagaagagtgttaaggccatcttagtcacttaacaagcagcatttgggaagaacataaaatgacttcaggccagttgcttttcctgaggggtacatatctagtccgtggtaaagactcttaaattcctggtcatctcctgccctactgtatgtggggtatagttaatttccaaccaaactctgtctctgtttttcttctgttgttttttttgagacagagtcttgttcttttgcacaggctgcaactgtggtgcagtctctgctcactgtaacccccgcctcccgagtagctgggattacaggtgcatgccaccatgtctggctaatttttgcatttttagtagtgatgggttttcgctatgttggccaggctggttgggctcctgaccccaagtgatccacctgcctaggcctcccaaagtgctgggattataggcgtgagtcaccctgcccagccctctgtctctttctctctccccctccttctccttccagacgcgcgcgcgtgcgcacgtgcgcgcgcacacacacacacacacacacacacagtgctgctttagctcagctatgaatgtatgactataggtcaacagtccatggtgctactttctaagtgatccagctgtagctatctccaaacacattgtcaggtacggtgggtggaagagggtggggagtgaagtccacaagatagccttcttcaaaaacattttctcaaaattatctcttaaaatcttctggtccaaatacataccctttttaaatcaagaatactttctagttaaatcttgcttttaggtatggcacctcatttgtttacagtgttatatcctgttgtgcaaaagaaagtttatttttaatatcctgtttatgcctataacttgtgaaggttagttgttagaatcaggtataaacaatacaacttaactattattaaactgctttacttaagttatatggtatcacaaaagttaccgtttgttggccttctacacacaatcttttactcttagaaatttacctacctggttctgcattttattgaatctgttttttcaaaggttattaaggccttgttagcaagttcttcatcggtgcttatgagcactgatgcctagaaatctccataatactaagccgtcatttttattaaaactttctctttccttgtctttcatgacactgttctgtactttggctgtcttcttacctaccttttgcagactgtttcttcaaccactttataacacacatagtttccaaggctctgtcctctgtcttgagtcctctaatcatttctgacttttctacatctgctgctccttcagtttctaactcatagtacttagtgttccaagcttagaaactcagcatcattatctactcgtctcttcccaaactagttgctagatcctgacacttgcttaaatcaaagcttttgtctttccttctgctaccacaaccctttaagttctcattgtttcaactgaactgttgcagtggcttctttctaacttgctttccttcctacagtgtctattagttgtcattgctgccatgtcaattttattcaatcataattacctgagacctttggtcaaaaacttcagtggctacagtataattatcaagtaagccaggccctccatggtcttcctttttagtgcttctacacatacatatctcctgctaaggttgaaccaactttcttttgtttctctacttgtgttcatactgttctatctttgtagaacgttcttcctcaaatcctaggtataaaatttctcccttaattcaaggcctacttgaatattctcccaaatttgaactcctcaaagcattgtatccgcaacttttttagtctatgtattgttttttatcctacgttacaattgttggcataaatatagaattgataatatagtaaacctaataatttggatgaaggcagtgaagtgactttaattagtagaaatagaatgtcctaagcatatgaattctaagaaggcactggggaaaatatgagttaaggaggtgagtttcctttcctgtgaccagaaacgattataacatagttggaatgtcacttatggagcagaaggtttgcagatgctgaactgcacatgcatcaacttttaatgatagaagaaaagccatataccaatcaagttaagatgcaatgtaactagctagacactaggagaagtttggatatgaatttggataccattagtagaggaaaatggttaagtttacaaagagatggacttggcttgtaaataaataggatccttagcatataacttggaaactatttggatgttgcatatctgttgattctaccatagatatggttttagacagtttcttcgtgttatttttgcctatcttactgggagtcactaatgaattcaacgcattcaacaaacatctatcaagtgactactacatcccaaatactcatcagggaatacagtgttgagcaaatatataaagattaccctaatggagcttagattttagcttcatagaaggaaaccccaagttaggagttgcacatgtttttgggaggtcctggacaaatgtgccatcatgttctcttgaccatttttcttgacatttgttgtcaccaggagcattgaaactaatgtgagatggaagactagataaaaaggaaagtccataagcctatctcatctatcctcctacagtatacattctctgaagaaaagatctgtgtttgattcacctttgatccccctatggcatgtccaactttgcacatgttaggcaaatgctatattctttgataaatacaaatacaactaaaatgatcatacatggtagtttgaaaacaaaaatcagaaaaatattttataaataaaatgggatgagaaaaggtaatgatgagattccagcatttttcttgttgttagggcttttcacactattgataagtccaccagaaaatgtttgagaaaggatagtctttatatatgggtttatatatgaattaaattatttggttttataattaggttttacttattctgagaagcaatgaactcacaaagtacaataaaaatataattcaatttgctaaaaaatgacttccgtgttgctttgcaggagcacatctattatataattcaggtgcacctgcctactttctggctcacacactctttgaacctgttttcagtgctgacaggttttatgaaaattatgacaggaaacaacaattataagcaataaacatttgctattgaattgctttctaaccatattaattttcattatcaccgtgtttagtggatatgttgaaaaacagaactgccctgaatatggaaaacaagactaattggggttaggcagagtgttttcccgctgcttccaaaagcctcttcaggcgatgctatttgaacacactccaaatttatttctcttccaattataaatgaaaaaagcaacaaggtctttatacgaaacatgtattaaacatcttacatatagtatactatattacttatagtattgaattactgggtactgactacaaaatgacatctaaaatatactctgcaatgtttgaatgtcttaaaagatcatatagacttatcaaactaattatattaactttgatatgattcacaaaataaagttaattttgagtcatgggaacatctaataaatcaagatggagaatcttttaagttcctaaattatattaaaaaaaatctcaaattggcaaaggaagctatgaaagcacagtattgagtttgaaataacttatgctaaaagtatggattatcatttttattattttttttaaccaagcatagttctgtagtatgaatcagggccactatcaataacaactcattgaaattttatccaagagagtacaacagaatattataaagaaaacacaaaagagatgagtatctttaccctgaacacaacgcaacttagcagaataaaagttagtgattctgaatagaaatgatgcccctttgtctacagcacaaatccccttagccttctataaaggccttctattagctaacctcagagtctgacacactaatacacataaagctacaaatacaatgggtcacaaattattcatatacaagttgattgtatttcttggtaccagaagaaacagaatattgtttgctatttctttataatggaaatagatttgatttactcaatagaaattaaaaattaatactactgatgtttttgttgagtagtttttcaccttccccagaaaggacatcgtacaaactctgtgacgaagtttataaaaaagaaggtgactgaaatgatgcaattattattttaatttaaaaatattacattttccacttatgagtctaattttattaaaatctgtgatttaaatgaatatcaccagtttataagtccatgtatctcctttcctgaagaagcattcattaaaaaaataagtctaaccaataatattcaaaggtttagaaactataattacctacatttattataatattataaaattaaatctcaagatacatgaaattttaaatactatatataaataagaatcaatttataattttcagtgattacaattaaaatgattataattatgattatcaatatcttaaatatttacatatagtacaaacactaaatataatactgtatatcctataatatagtatatataaattatactaaacttttttaccacattatacatttttgcttattttagaatttaaaaaatttagatttagatgacttgagtttcatagactaaattattacacttacttgaataatttcttcacattagacattcacatttctattaatccataaacactgataaatttgttaagtgctgataaaaatttactactctcttgttgctgttagtacagctgttatttttgctacatctatttttcccccacagaagagaacttctaaaaatcagcagaactaacatttctccttttgattgtacctacttcattccttcatttaaagcatgaaaagaactgctctacatctgaccaaagcaatgcacaaggaaacaatgttttagaacaccctttctcatccttcactgtcacttccaatctagcattactttttcatccctgatttctctgttaacagttgatcatcatgatttgctatttgatcctgtcaaaaatctgaggccccaaagctctgaccccacttcctttctcttactaaataaaacatcgtttagcacaccaacaagatcttcaatgcaggaaaaataaaactaggacaagaaaggtatgaaaaactatcaatatttctcattgtacttgacatgccataatagctaccattctctctctagtctattcttaaatcttttctactttagaaattctccctgagtgatctcatttgttcctataactttagctactttctaatttctgaaaactgtcagattttaatctttaacatagatagagcctgacttaacatattcatctgtttaatggacagattcacttggaaaaatataggtaacctaaacttaacatatttaaacccattttattatttttcttctttgaaatgtaatctttttcaatatagaattgataatacctttcttgttatcaacacaaatatatacttctattgcagctcttattcaactgcatagtccattttttttgtatgactcaccatgtgacagctgtgagttccttaaatgcaggcagagtggcttaattttttttgtgtgtcctcagaaaataacacatttttggcaaatactcaacgtttgatggctgaaaaaacatgcctctaatttttgtcttgcgtttaattttagaatttccatctatcaagttattcaaataacaattttgtcatagtcatccaaacttcttcctttgttcctcttcccatccttccactcaccacatcattctatatttggttatttaattcaaatggttcctcttcacttggaatgccatcttcttctgcctgtactatttgaatacctcctaacttgtcttcattcctttcatatctcctctgttaattactgccaaatggatgttatttaaacacaaatttgaatttattctgtttaaagagtcttccctggtccttcattggcagcaaatagtaaccctttcagtttggcatcgaagactgttcttaactcaccttccaagactgcctgattccctaattaccccatgtgatagccacactctactacttggcactttgaacattcattaattttgaaattaataaatttgtaatattgtaattaacatacattaatgattccattaatatacttaaagcatattggtctttacctcgtcttaaatcatttcagtaattttatcttttgaaaacatttatccctttcagagaagtcttcagacacattgccgttgatttatatatagactataatacttttaaagtatactttgtcaatggttatgtccttattttatctctgttgttctaaaatttcttccctcacccccagattaacctttcccagagacagagaaagccagcaagggtctgggctgctgtgatgctttaattaaaagtgttccactctgttctgttttttattgagggtacatgagtaatattttgcaaaatatgtttgcagagttttattaagaaagggcatgcaggactgacttcacatgtgaagctacaattaagctgctgcgtgctatgacccaggcctctacgttgatggtccccagacttgttcccatcatggctgggtggatcaggcactgagaacatgactcgtgctgtttaaacatgaccatgtgattgaaactaggtgccaattaattaattcttaaaatatatcactttaatacagcttgggatactgacattgtcttttttttaattatactttaagttttagggtacatgtgcaaaacgtgcaggtttgttacatatgtatacatgtgccatgttggtgtgctgcacccattaattcaacatttacattaggtatatctcctaatgctatctctccccactctccccaccccacaacaggccccagtgtgtgatgctccccttcctgtgtccatgtgttctcattgttcaattcccacctatgggtgagaacatgcagtgtttggtttttctgtccttgcgatagtttgctgagaatgatggtttccaaactcatccatgtccctacaaagcacatgaacttatcattttttatggctgcatagtgttccatggtgtatatgtgccacattttcttaatccagtctatcattgttggacatttgggttggttccaagtctttgctattgtgaatagtgctgcaataaacatacgtgtgcatgtgtctttatagcagcatgatttataatcctttgggtatatacccagtaatgggatgggtgggtcaaatggtaattctagttgtagatccctgaggaatcgccacactgatacctacaatggttgaactagtttacaatcccaccaacagagtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaaatgtctgttcatatcctttgcccactttttgatggggttctttgttttttttcttgtaaatttgtttgagtacattgtagattctggatattagccctttgtcagatgagtagattgcaaaaattttctcccattttgtaggttgcctgttcactctgatggtagtttcttttgctgtgcagaagctctttagtctaattagatcccatttgtcaattttggcttttgttgccattgcttctggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcagatttgtcaaatatcagatagttgtagatatgtggcattatttctgagggctgtgttctgttccattggtctatatctctgttttggtaccagtaccatgctgttttggttactgtagccttgtaggatagtttgaagtcaggtagcgtgatgcctccagctttgttcttttggcttaggattgacttgacaatgtgggctcttttttggttccatatgaactttaaagtagttttttccaattctgtgaagaaagtcattggtagcttgatggggatggcattgaatctataaattacctcgggcagtatggccattttcacgacattgattcttcctacccatgagcatggaatgttcttctatgtgtttgtatcctcttttatttcattgagcagtggtttgtagttctccttgaagaggtccttcacatcccttgtcagttggattcctaggtattttagtctctttgaagcaattgtgaatgggagtccactcatgatttggctctctgtttgtctgttgttggtgtataagaatgcttgtgatttttgcacattgatttagtatcccgagactttgttgaagttgcctatcagctttagaagattttgggctgagatgatggggttttctagatatacaatcatgtcatctgcaaacagggacaatttgacttcctcttttcctagttgaataccctttatttccttctgctgcctgattgccctggccagaacttccaacactatgttgaataggagtggcgagagaggtcatccctgtcttgtgccggttttcaaagggaatgcttccagtttttgcccagtcagtgtgatattggctgtggatttgtcatagatagctcttattattttgagatacgccccatcaataactactttattgagagtttttagcatgaagcgttgttgaattttgtcaaagaccttttctgcatctattgaggtaatcatgtggtttttgtctttggttctgtttatatgctggattacatttattgatttgcgtatgtggaaccagccttgcatcccagggatgaagcccacttgatcatggtggataagctttttgatgtgctgctggattcggtttgccagtattttattgaggattttcgcatcgatgttcatcagggatatttgtctaaaattctcttttttggttgtgtctttgcctggctttggtatcaggatgatgctggccttataaaacaagttaaggaggattccttttttttctattaattggaatagtttcaaaaggagtggtaccagctcctccttgtacctctggtagaatttggctgtgaatccatctggtcctggactttctttggttggtaagctattaattattgcctcaatttcagctcctgttattggtctattcagagattccacttcttcctgatttagtcttgggagggtgtatgtgtcgaggaatttatccatttcttctagattttctagtttatttgcgtagaggtgtttctagtattctctgatggtagtttgtatttctgtgggatctgtggtgatgtcccctttatcatttttttattgcatctatttgattcttctctattttcttctgtattaatcttgctagtggtctatcaatgttgttgatcttttcaaaaaaccagctcctggattgatttttttgaagggttttttgtgtctctctctccttcagttctgctctgatctcagttatttcttgccttctgctagcttttgaatgtgtttgctcttgcttctctagttcttgtaattgtgatgttagggtgtcaattttagatctttccttctttcctttgttcgcatttagtgctataaatttccctctacacactgcgttgaatgtgtcccagagattctggtatgttgtgtctttgttctcgttggtttcaaaggacatctttatttctgccttcatttcattatgtacccagtagtcattcaggagcaggttgttcagtttccatgtggttgagcggttttgagtgagtttcttaatcctgagttctagtttgattgcactgtggtctgagagacagtttgttataatttctgttcttttacatttgctgaggagtgctttacttccaaccatgtggtcaattttggaataggtgtggtgtgatgctgaaaagaatgtatattctgttgatttggggtggagagttctgtagatgtctcttaggtccatttggtgcggagttgagttcaattcctggatatccttgttaactttctgtctcgttgatctgtctaatgttgacagtggggtgttaaagtctcccattattattgtgtggtagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccgttttttgttttccatttgcttggtagatcttcctctgtccctttattttgagcctatatgtgtctctgcacatgagatgggtctcctgaatacagcacactgatgggtcttgactctttatccaatttgccaggctgtgtcttttaattggagcatttagcctatttacatttaaggttaatattgttgtgtgtgaatttgatcctgtcattatgatgttagctgcttattttgctcattagttgatgcagtttcttcctagcctcgatggtctttacaatttggcatgtttttgcagtggctggtaccggttgctcctttccatgtttagagcttccttcaggagctcttttagagcaggcctggtggtgacaaaatctctcagcatttgcttatctgtaaagtattttatttctccacttatgaagcttagtttggctggatatgaaattctaggttgataattcttttctttaagaatgttgaatattggcccccactctcttctggcttgtagagtttctgccgagagatcagctgttagtatgatgggcttccccttgtgggtaacccgacctttctctctggctgcccttaacattttatccttcatttcaactttgttgaatctgacaattattttcttgaagttgcttttctcgaggagtatctttgtgggattctctgtatttcctgaatttgaatgttggcctgccttgctagattggggaagttctcctggataatatactgcagagtgttttccaacttggttccattctccctatcactttcaggtacaccaatcagacgtagatttggtcttttcacatagtcccatatttcttagaggctttgttcatttctttttattctttttgctctaaacttctgttctcactttatttcattcatttcatcttccatcattgataccctttcttccagttgatcgaatcagctactgaggcttgtgcattcgtcacgtagttctcatgctgtggttttcagctccatcaggtcctttaaggacttctctgcattggttattctagttagccattcgtctaatttttttccaaggttgttatcttctttgccatgggttcaaacttcctccttttagctcggtgtagtttgatcgtctgaagccttcttctctcaattcgtcaaagtcattctccatccagctttgttccgttgctggtgacgagctgcattcctttggaggaggagagctgctctggtttttagagtttccagtttttctgctctgttttttccccatctttgtggttttatctacctttggtgtttgatgatggtgacgtacagatggggttttggtgtggatgtcctttctgtttgatagttttccttctaacagtcaggaccctcagctgcaggtctgttggagtttgctggaggtccactccagaccctttttgcctgggtatcagcagcggaggctgcagaacagcagatattggtgaacaggaaatgttgctgcctgatggttcctctggaagttttgtctcagaggagtacccagccgtgtgagatgtcagtccgcccctactggcaggtgcctcccaattaggctactctggggtcagggacccacttgaggaggcagtctgttccgttctccgatctcaagctgtgtgctgggagaaccattactctcttcaaagctgtcagacagggacatttaagtctgcagaggtttctgctgccttttgtttagctatgccctgcccccagaggtagagtctacagaggaaggcaggcctccttgagctgcggtggcctccacccagtttgagcttcctggctgctttatttacctactcaagcctcatcagttgcggaggcccctccctcagcctcgcttctaccttgcagtttgatctcagactgctgtgctagcaatgaacaaggctgcgtgggtgtaggaccctgcaagccaagcatgggatataatctcctgctgtgccgtttgctaagagggttggaaaagcccagtattagggtgggagtgacccaattttccaggtgccatctgtcacccctttctttgactagggaagggaattccctgaccccttgggcttcccaggtgaggtgataccttgccctgctttggctgacgctcggtacactgacattgtcatgatcattgtattgtttcctacagccatgctaatggaaggaggagaatatggaagaaaattataattagtaagtcgttggtaatgaaaaccagaacacaaaaaaattggacaaattacaaaaagagacattttggcaaaaaatgtttataaaaagtgaaatgtgttaaagaatacctcatgaatactaggaaaatacaaatttcaatcactattaggtatcataattttatatctttcagactggaaaaataaatctcataattgcaagagttggtgaagatgtggattagatgaaactgttacatcttactgggtctagtaaacattttgtacaacacattggaaaactatttggcagtatccagtaataattaagaagtatgtaacactatcaatcgttttcctagatatttctagatctcttgcaaatgtactcaaggaagcatatgtaagaatatccagaatagtatattttgtactataaaataagaaagacaaatttccattaatagactatcaaaagtatgaattatgatacaggtatagaaaggaatactatagagcagggaaataacttctacaaatataagtggatcaatttatattatggataaatttctagagcatattgagcaaaaggagcaagctgcaaaacaatactgcatttgttatttacataaatttttagaaaaaataaaataatcctatctattatttagtgatatatagtaagaatacaaataaacacatggatgataaagataactcagggtagtgtttattcctgaggaggtggtagggttatgcaaagtcttcaaatgtgttagtaatgttttctttctttctttttttttttttttgagacggagtcttgctctgtcgcccaggctggagtgcggtggtgccatctcggctcactgcaacctctgcctctggggttcaagccattctcctgcctcagcctcccgggtagctgggactagaggtgtgtgccaccacgcccagctaattttttgtactttttagtagaggtacagggtttcactatgttggtcaggctggtctcgaactcctgacctcgtgatccattcacctcggcctcccaaagtgctgggattacaagcatgagccactgcacctggccgtaatgttttatttcttacactaggtagcgggcatacaaattattgttacattattctttatatctttatgcaagacaaattataaagtcattggtaattataaaaattagcacccagaaaattagagaacacttataaggccacagtgagatattctaatgcctcaatccttctaatttatcttctgtcctcatcattccagtgaaacaactgtcactaaaattatcattgaattcaatggctcattaagatttcaaaatacagtcatagtaattcatattttatgcccatttttccccctttggtatggctagtatggaaagtctttggaaatgagtgtttgagaatgacaatgaataataattagtaagtagtaagcctaattaagcatggttgcaataatagcccctgtttcagatgtgatcactttatgaaaccaaataaataatgttttctttacctagtatgtaaatattcagcaaagcctttttttctctattctgaaaagatgggaactttagaattagtttgcctttgcctagcaaggatgaaattataccttcacagtcttgtctcaaggttatatcaactctccaacactgtatcacaattcaatctatgaggaacttgtttgccaagtattctgtttgatgatcttccatgttgatgatatcttgttgacaatatctggtgatcggacacagaaatagacagtatctagatgccttaataaaatatatgagtacttaagcatggaggataaatctcatggaaattaaggaagctgacacttaggaaagtttcatgggtcctttcatctagagcattcctttcacctaaaatatccctttccaaacagaaaaagttactgctagctggtgggttaactacaaccataaaggagcatgctgaggacaactggcacactaagaataacatcacagagaatttgaaaaaaattgtatctttttctgtatgattttcaactcaagaaatatatttaaattattgctttatatagataatcttttcctttttgattatttgagactgtaattctgaaacagtttttcttattctggaaaatttccttttcaagatgctaaaccgtctcagttttttgtttttctgaggatatacttatttggaccttattgtctaaatgaaggtttacctgtgcagatatttctagactgatatttagcttctctgtgcaatttgaaaatattatttcactcttgatttaaaataattgtatatatgctagaataattatactactttctgtcaatcatttttaacttatcttgcatatttgctttgtctctctctgctacattattcaggcctaacttcctgttctttaattcttttcttagctatacctaatctgctgtttaattcaccttttaaaatttcaatgatgatatattttattacattgcctggaattttgtgatagtttctcttttgccctgcttgtttttcaatttcctatggcattttcctgagcatttaacatatattagttttttatttttgagtttaatgaatctcacagccaaaatcctttggagtataatgctgctgtttattttttttttccacagcattttgcctggggagctcatctgttttagctggtattcccttttttattatgtggtttttttattgatatttattggtgaggatcaatagtaacccaatttgtagaatttacatttgcaaaagtaaacttacatttgcttcttccaaatatcctgacactttcatactggcacttcttatatttctagttgagaatttcttcaaccacatttgtaaaataagttagaaccctgaaccttacatgagagaagggtcattaaagaattcttagggtagggggtggttacttacccaactgtagctgacgtggctgagcaccagtagttttcttgttgcttttcttttctgttaggcactccccctcctccacctgctcattgtcattgaatctgaagtcccttggagttctaaactttatttattaacagttttcagtttcaactcttgattttgttcaggcacaaagatctttttttttgtgtctcatgctggccttgaaatcctatatcttaagtagctaaaaccagcaaatgttgtggtatcactgtctgtcatgcttttaaaaacggattcctctcagttttttggctcttactgcattcctttattttggaactgtggaaatgacattctgaactcaactacaaattcaaaagaatgtttattttattttgtccaacattttaatagatttttttttttagtgggaaggttttcagactatcttctgtgccaactgtcaaaagtagaatcccagtgctatattttgaagattgtgtagattatttgaaacccaagtaacagcaccatctctctcaattagacttgcctggagacctaacagcaaaagtttccttaaaagcacagacgaatcaaaaagcctaataacttatagaataaataatggtttcttcagtatttcttattcatgtatattcatgatgcatgcatgcacataaaagcaaaacaaaatgagataaaatgttttgagaacaaaaacaaaaatagaaaaccagaacaaaacagaaaccacaaacttggcaacaaaaaaaaaatgattttgtttgttaggtttatcggtatgtctctacaaatatgaaaaatgtagagtaatagtctaatagtctagttcccattttttttggcaccagagactagtttcatggaagacattctccaaagactggggtgggatgggggaatggttttgggatgattcaagcccattacgtttgttgtgtactttatttctattattattacattgtgatgtataatgaaataattatacaactcaccataacatagaatcagtgggagccctgagcttgttttcctgcaactagatggtcccatctgggggtgatgtattagattctcatagggagtgtgcaacctagatccttcatatgtgcagttcccaattgggtttgtgctcctaggagaatctaatgccactgcttatctgacagcgggtggagctcaagcagtaatgagagtgatggggagtggctgtaagtacagaggaagcttcgctggatcacccaccactctcctccttctgtgccgccggttcctaacactccacactgataccatggcccgggtgctaggaacccctggtctatgccacttgtagataatttaaagaattgaatgtgtagcataatattcttctttatgtttttgaaataatgacttttaaatataatattaagttcccaagtatttcaaagtgtgggtaaaatacatagaaaattgccagaaaaatactgaaacacacttaagaaaaagcttagaagattttttgaagagtaaattttttaaagtaaatagctatcattttcaagagtgaattttggcagacttttctgactattaaaatgatgaatattgacaataacactaattcataaaaatatcttaaatgataataaaaagaaacccttcccataaggcaaaaccaagatgattaagctgccaatcagaaaatcttgattatatcaaatactctagtccatttaaaaatagccattgtttatgataaactgcagttgaatgaagagaatatttttcaaaatctaattactacatcaagtatttgtatcaaaatgagtttagtattttttattttacaatagattataagcaaagaaaaatctaaacttttacataatgatttttaaaatactaccaaaattcttgtatatttgattcacattgtgatgattatgattattttgattgtaaaagcgacattaccaaagtaaaataatagtttcatattgtaatataatttgatatttattaaatggatccacataattaatgatgttctttttttagctatcaacatacctttcagaaatacaaacatatcttttttttcatgacttcaaatatctgtagtgattttttcccaacctacaacttcctagcttagtagagggcagagcattcacatgtaattaaaaaaatccttacttaacagagaacatttgtagcatggtgtagaagaaagggaatatgataggtagagaaaaaagatgccccacatgatgcctttacaatagaaacagtttaaagcctggatgatgatagaacaagatggtttgaatcaaactcctagaggaagaatatactgcaagatggtggttatgggaggaaaatctttcctacccactctatggaagaattgtaaactagataaataacttaccagcaaaagaaaaatgttataaactaacatgaatactattgttaaaatgccagaagacattatgagataaggaaacacttattcattataaaaatatttcaaatgaacttttttcaacgtgtgagggaggatcggagatatactagaagtagacccttaattcacagaatttccactctaactgggaagttagtcaattaactacttcaggcagcatataattagctacttataccaggagaaagaggcaagaacatgagcaaggggagcaatgtagcaacctggaaggtacattgagaaaagtctgaagttcagttggccaggagcacagactatgcgagattaataggaaatagagctagaaagagaggtaggaggaggatcatagatggtgatatgccagaataaagaaattgagtttcattctgcagtcaggaacattaaacatctatgagcagagaagcagcaacattagaattgctcatcagtaacactaagctctcagcaatgtacaagcagcttgaattaggaagagcaagaagtgtttttaaaaaagctttaacaatagtacaggtgagaggaaatcaggatcaaattaagaatgagggtaataacaagaaagagggaagagactggaaagactttctgagctaggagagacaggacttggcaatgagtatgttgtgggttaaggtgaagtgagatcttaaggtgaaacagcaaagttttaaagtctgagtgacctggataatgattgagacagaaatgaaaatgggaaaccgaggatgaagagttgagcagtgggagagtaatgaaaccagtatgtacattttgattttgttgggtatttatgtggaaataatcagtaggtggtttcaaatatggaagaaatgagagctggacataaaagctgaagagcttaccacaaagatggaatggtaaccttataggaatctgatatcaagttgggtaaagataagatgcattttttgaattgctatgataaagaggagatgggagaaggagaaatcaggaaggcaggaaataagaagtcctcttgtactgaaatctgatggagggagaactaccaggaagcaggattagctggtagtaggaaggagagagagagtgagtgtgtgtgtgtgtttgcttatgtgtgtatgtacatgtgcaatagctagcaagcacataactgtttagcaaggatggacccaagtgaatacagagaaggaaataaattattctcattttctgttttactgctttagtcattagctaaaatcttgcttcaggttgtaggtgccttgaatatgggatgaactgaatttaatgatagtagtttactttgttggacctctaaggggtgtcttactatagtagtcagttcaaagcctctggttttaaaagagcttagaagtcagctactttttactccttcaaaagatggtaatgtctctatgaaaatgaggatgttctgggtaaaactcacttataatatctctcttctggcaagctttttttttttttttttaaagaaatatacagtagtttccaaacttgttattttgcagcattcccactaatcctgtttagtcttaaaattgttatgacatcttgttttggtagtcacgaccatcaacagccttttaagtcaattctctttataaactgtacaaatcggctactatttgtgtgtcctgggactagataaagtatgaacagcatcatattcagttcaaccaatacagataattttatgtttctgaggcagacactgagaaatagagagatgaatgaatgagagagagggggcggggagagacagaagatgaaagagagcagaagaggatgaagaggagaactaggagtaagaggaaagaaaattcaaagtgtgaggaagcagaatcatcagaatctgcaagatggtggttatgggaggaaaatctttcctacccactctatggaagaattataaactagataaataaataaaatagcttttattgaacatcgctacgtgccaggcaatgctctcaaaagcactattatctctgtttttgaaaattaataaactttatttattagagtattaggctcacagaaaattcaagagaaaagtagtttgcatatacttcctgtccctacacatgtacaaccttctccactaatgacatctcacatggattgttacaatccatgaacctatactgaaacatcgtcaaagtctatagtttacgttggagttcactcttggtattgtacattctatgggttttaacaaatgtacgacatgtccatcattgtaatatcatatagaataatttcactaccttaaaagtcttctgttcagcctattcatccttccctccctctcatcccctggcaaccactaatcttttctctttcactatagttttgccttttccgtaatgccaggcagttgaacttatacaataggtagacttttcagattgacttcttccatttaataacatttaagtttcctccatgttctttcatgacatgatagctcatttctctttagcactgaatagtattccactgtctggatctaccacagtttattaacttttcttgcttcgaagtctgctttatctgcaatgaatagagctactccagctttcatttgattagtgttagcatggcatatctgtctccatctccttacttttaagctatatgtgtcttcatatttgaagtgggcttcttttagaaaacatacagttgggtcttgtttttgatacattctgaaaatctgtcttttgttggtatatttggtctattgatgattaaagtaattatttatataattggattaatagctaccatatttgctggtattttctatttgttgcctttgtcctttgctcctatttttgtcttctacatttttatgccatttgtggttttaatggagtattttatgtgatttcattttctttcatttcttagtatatcaattgaactttttttaaaaaaacttttttagtggttgcactagagtttgcaatataactaatttagaactaatttaagtactttcaaagtactccctggcaaccaatgtcctcaatttttgtttgcctgaaaaaaaatctttgatgaataattttgcagatacaatagaaaaaatatgaacagatcttttgaagaataattctgcagatacaaaattataggtagtgttttttttctgaacactttaaatatttcattcctttctgtttttgtttgcatggtatctgaggagaaatccagtgcaattctttgctcttctatagggaaggtgctttttcctctggcttcttttagaattattttgtcttttattttctgcattttgaatataatgtgacttcatgtagctggttttgtgtgtgtgtgtgtgtgtctgtgtgtgtgtttttggcatttatcgtgcttggtgttctttgggcttcctgggtttgcggtttgatgtccgacatgaatttgaggaaactcagccattattgcttcaaatatttcttttttccattctctcctttttcttcttctgatattctcattacatatgtgttataccttttgtagtcatctcacagatcttgggtattctgttcttttttcccagtctttttttttctttgtttttcagttttaggattttctattgacatatcctcaagctcaaagattcttttctcagcagtgcccagtctactaagcccataatggcatctttcatttttgttatagtatttttggtctctaatattcctttttattcttagaattttcatctctctgcttacattattactactatctgttcttgcaaattgtcgactttttccactgaagccttcagcatattaatcatagttttttaaaattcctgacctgatgatttcaacattcctgttatatctgactctggttctgatgtttgtacagtcccttcaaacagtgtatgagttggattctctagaggaacagaactagtaggagatatatatatatatatgtgtgtgtgtgtatatatatatatttatatatatatatatatatatatatatataaaggggagtttataaagtattaacttaatgatcacaaggtcccacagtagcctatgtgcaagctgaggagcaaggagagccagtccaagtcccaaaactgaagaacctggagtctgatgtttgagggcaggaagcatccagcatggaagaaagatgtagctgggaggctaggccagtctctttctcacatttttctgcctaccttatatgtgctggcagctgattagattgtgcccaccagataaagggtggatctgctctcctcagcccactgactcaaatgttaatctcctttggcagcaccttcacagacacacccaggatcaatactttgtatccttaaatccaatcaagttgacactcagtattaaccatcacagtgtcttttgcctcctagtattcctcatatttttttgttgaaaggtagtcataacgtattgggtaaaaggaactgctgtaaataggcctttagtaatgtagtggtaaggtgtagggtgaggggaagagttctatagctatgattaggcctcaatcttttggatagccggtgtcctcagactaggaacttaccagtacttcttaattccctttccctactcttaggtgggaaaggatagttggagtgggcaggagctgtgtatttccctttcctgaggtagtttaggctctgataaaatcccagaaggttaggttctgataaaacagtttctcttgagggtagatcttgttgagaagaacagaatgctctgtcatatttcaaaatgactctttgcttttcctcttgctggaagcatgaaggaatttttctctgacattgattttgaggacctgatagggttactgaggggaaactcaaaaaagtgtgaggaccctcctatgtttgtgtccccttggaattttctcagacttgtctacacccagcttccagcaacttgtcaattacagttcacatttttgtaccctgggactggttctcacggagatttctgctccaataaattataattctctgtattcagctggctgtttttccaatgttgagggctgttgtttgccttgtgacattacttctctgatggagctcattaaagtttttgtttttttagattgttcagctttttgcttgttatgacagaatggtgacttccaagctccttacataatggactggaaatcagaagtccactactgcttttttttttttttttttttgagaagatagctgaatctttaagcctccgtaaaaggaaagcaattttctgaatgttgcagttagaaacacttgcctttgaagactaattctgctgcttattaattctaaaattgagaatcttaaaatgtcacctgactctgaaaaggttatggaagaatgactcccacacagaggttctattcctgactgccatggtcccactttccacccgatctctcctcctcactaacgctgttgccttgaagactttgtctgttattggaccccatcatccccataatattccttccacattactctaacaatgatattgtctaacatgttttgaactctcatttggtgagagctaaatatgatttttacttggataatgtattttgaccttaaatacaactctatggttacccccttttacaaaggagaaatcaggcacctggaaaggtcaagtaacatgctcaggaacaagtaaaggtcacgtaacactctcaagaacatgttgctaggaaatgtcaacttagatgctataacttcagagaccttcctctgtatattactgctattgcattcagtagaacatttacatcagctgccttatgtgtttggataataaactgtatttttgtattttaccattttgcaatatgaagtaactaactctgtaaacattaattattactctatcattattacatctttcctcccaattttatgcatataataggtttttaaacatttttgtttttcctcactctactaatactttacacaaagcatcacactaagttttttactttcttcaaccttcctattttcttcattattccatccttaatcctattcatctgtccgttctatttctttcatttctttgaaacctgtggaaaggcattttaaataattatatttctatgtaatataaaataatttttagtttgctatatctattttgagatcacaaatgcaatgccactgatataattatcaagttatctcatgcactggaaataatcacaaactctaaaaaagttaatgaataaatgactaccaactgtaagggattatgactataaccacatgagtatactatttcactatttgaaatgcctcacatgcaaggagaacttggacagatgaaggtcaaaattcagatataaacctaaaaaggttcagtagtacagttcaatgggaaaagtacattagaaagtccatgaattgctaccacttacatgcctggtctttttatctgtagcccatatgacagcacagtctcattcaataaaactctttgattttgcctaagaaccatgagtacaaaaacacttgaatatatgggaagttgttgggttcaagtgtggggcaagcaatgggtatgaaaataagggaaagtttgaaagttcatattgtaaaccaattttctctcttctattaaaaactaatgggatagaagagtgcttccaaagaaacctcttagaaatcacagctagagattgcaaacacattgtttggctggtaggctccctgtctttttttctataacagaatataggcttctgttggattaaggataaaaatacattgtaaagtgctacacggtatgaacctggtgattaacgatattttgttcacatagaatctaaagaatctttttttttaaaaagtaagcatggaggaaatttaaaggctttcttactccctctttctacactccacttcacataaataatatagacattggggtaaagaatgaagtagaatattttatatatgtatatgtatgtatgtataacttagacatactctcagattactccacattgacctttaatgatactcagatttctcgcattaggcactgaggggatggatataccatgttataaaaaatgttggtggatgactctgtgtgtgtgtgtttgtagatcagaagatcagttttgaatattaactttgatatctaaaaagacatcagagtgaagatgcctgtatggtgtttgttggctatggctatatggatctgaagtttacaggcatgatctattctgaagatgcacattttagaattaagggaattttattaattgaagctgagcaatgggtatgggagagatttattttatatatgtatatatgccacatttttattttaggtgtgagagatttctttagagaatatgggaagataaagaagaaaatgaggtttgatattaggacctaaggaactgtaaaaagtgagaggatatagcaaaggagtctaaaaaaggcagacagagaggcaggcaccataaggaagtatggcattagaaaagctgaaaggagacagtattttggaagaaagaaccctcagttgtgtaaagtttctagatcagcctgtgttacagcagggctagggagtaaggaattggcagtactgaattagaacctataaattaatatttgaaaaaaggagaagaatcatagggcagtagctgcacagtagtagatttttggaggaattttattgaatgggaaggactagaggagtttaaatgctgtcacaagggcctagtagaacaaaagaagttgtagatccaggaatgagagtgaacatttcatagtttctgttacagggggaatatgatctgagttacttagggtcttaattacaaaaagtaaaattcactctactagtttaagctgaataaaatagttgtacctcattggcagagactctgtcatatgtttatgtctgccttagaaggcaggggttatgttgtagaggcaaatctcatagcaagatattttctaaaatacagagaaggtattataaagatgataggcacccaccataggagaaaaagaggctataggagtcgagcacggatggaagaattggccttaattagtagtttagaaattgtctccatggcagtgcggataaaaagcaaatgggtgatgatctgaaagttttgaaagttgccatctgagggcaacaattttttttctcagaaaagtaggacacaaattgagaccgaaggtaatagtgaatgtctgaggtttgaaaatgtggaaaagattgaaaatagtcattgtggagatagggagagaaggctgagaaaaatgacataatatttatgagctgtgtggaagtttcagtgtaaagtggtggccatgaatttatagtagtaccaatcttcccagctagatgactttatttttaaatagtaatcagaagcctgggtgatgacatggagatgacagatacccaggcttatccagatttaaattctggttgaaagtcctgtgaaatggtagagaagaatgaaaatttaaatatattagaaagaaatatattatggaagcataaataccaaatacattctcatagccacatactgccattggctaatgttatataaaatcccaggtgtacttgagccattagtgtctgctcataaggacagatatttatccctattatatatttaattttaattgagttgctctgttattccatgcagctggttaaaattttttggctttgattttgtcatcccttacattacttttctttcaggctttatttcacctgaaaatatgataaacagataatatcttaatccaaattactaatgaaaatgttgaatgagagaaggcaaattatataaccctctaatatgttgttttaaagagtttaatccaaattcttagatatggggattttaataatcattttctcagtgatagaatcacaaaattttatagctatgccatacctggactccatgcatttttttcacagccaagaaagctgttggtcaagaagtttaattgatttttcccaaagcagcgactgggtggtggacgttcaacaccagactgagtttgtatatatgtattttttattttttaactgtatattgacaaattataaggtatatgtttatggagtacaaagtgacattatagtatatataaaatatatacacacacaatgtgaaattattaaatcaagttagttaacatacccaccatctcaaatacttaccatttaatcctcctaaccacaacattatacattgacaaccagttctggaattggtggctttttatacactagtcttttctatcacatgaaacaagttcttttcacattcaaatggtttttgacatattaagtaaatttttattttctatgaattaaagaataaaaatttacttaatttttattatatatatcttctatatatctagaatagatatatatctagaataatatatatctataatatctatatatctctctatatatatcttcaggaaatttgattctccactttttagtagttttttggttacaaatgttactgtgaatgaggtcccagggggagttgcattaatatcatctatcccccagagattgtagtcaggagacactgcactggcatcgtgaaaatgaaaatgcaattacaacaatgtagagttctgtaattataaattaaattttcattctatctgttccttaaggttatgttgattgaaaactgaaaactagttttgccgttaccagttgataaacaaaaagtttatcatagacaaaatgcagactgtaatatgatatacaaagtccatttgaaactatttttcaacctgtaaatgtaattataattagagttatactaagttataaacttttataacagtaaatgtcttttatttgttccaaattgggaacaaattaaaatttagttttaagaatgttttcacatttaatcactgcagtactataacataggctttgaacagtgatactggcgtttgaatctcagatctgttatatgatagctgtggttgaatattatgtaatctttttagcttcagttcacttgtatgtaaaatgagaagcacattacctgtctcattaggttgtgagaattaaataactatatttgtctctaaagtacaaggaacaatctctagtttacagtatttactccgtaaataacagatatgacttttgcacttatagaataagaaagaagggagcaaaaattccttgacagcattttagcaagatagaaccctctattgtgtaaaaagtttctagatcagcctgtgttacggcaggactagagggtaaggaattggcagttctgttctctttttctgaatggagttagttttaattataaactttaccatgggaagcatctagagatacatcacatataattttggtaccgtattttaaatgttataatggctatattcttttatatttcaactagtaactgtgaagagtgtttcttactgtcctgttttaaaacagctacgaaagttgctaacatcagtctacatcacgagttggcaagcaggttaaatccagcatgctttcagtttttgtaagtaaaattttattggaactatgcccattcatttacatattttctatggctgctttcacagtacactggcagaattgactggttgtgtcagactatatgacctgctaaacctaaaataatttactacctggccctttacagaaaaaaacttaccagcctttgttctacttgatttaaaccatgaaagctatgaggaaaaagtggtaaatagattgaaaaaaatttctccagacaatattatgagctagatttgaaaaaacattgatatataaggtgcaaaattctggaatttactaaagaagttataattattgaaatattccctggtatttttgtcttctattatttgctatccattatactttttattttaaaattttatttctggtgtttattgtttattttattagctttattcttcataatgcctttctaaactcaaaaatataccacctaaagggctgatatctgcaaggtggtagagtagaagactccaggcttcatcctgttaaataacaattagacagctatccatgaacaaaaatagccctaggaagagctcaggagtctcatcaagaacctatagcagcacaatagggcaaaaacactaaataatcgcatagagaggattgcttgggtgattgatgtgccagaaacatctagagatagctaggtatgaagataagggaaaggggctatcactgtcagccatgcagtgagtgccaccttgctttctagtggcttactctgcagagaattctggcagtcttagtcacagggctgtcaacagccaccatagtaggtgtggattttccatagatttcacagcaaggtctccttagtgtttgtaggcatggaccccagtgcctgttccacagagaactctggcagcttttgccactgacgtaaccaagagctgctatagtgctgaagatctccaggggagggagatgctgcttcccctcgcccaacccaacaagaagctacagatgtgcttccctgggacctagatccccagctcccctgcagccccatacatgcccctgaccctggagctgcggccactctgtgccttgatcattggagccactgccaaaatgaggtagtctgtgccctggaactcagacttgcagtcactttatgcatgcccaagctctagaccttggcgctatggctgctccaggagtgcctacaccatggacactgaagctacctctgtagaaggtacatctatggcccagacccaggaacagtggttgctctgcacatgagtatgtcccagatcctggatttcaggcttctctttaagcacctgtgcttcatgcaccaatgctgcagttcgggggtggggttggagagaggtctgaatgccaccattgccctgaaccctggaactgtagtcattgtgtgtcacttgtgctccaaatcccaactctgtgctcactacccaggcgccacacaccaaacaccactgccatcaccactgtgagcatgctcataagctggacctggcaccaagaaggatccttttggccatgattttccccatgagagaaaaagagataaggaggactccagcagccttcaccactaaagactccaacagcccttgccactactgtggatactcatagttttagcagctgaggatccctgcaatctttgccagccttgatctcagctgatggaactgcatagagtctttacaacgacaccctcacctagccagaaccacctgaccctacccagctggtgtcctcacatccacccataggcaaaggtctttacccacttaaaccagtgcaaaaagtcttgaagaagactgttctattaaatgtgcaaacattaactcaagatgataaataaaaatcaaagaaacatgatatcacaaaatagaacacacacaccgtaatattctagtaacagacttcccaaagtggagatctatgaatttcctaacaataaattcaaaatattaggttggtgccaaagtaattaccattaaaagcaatggcaaaacccacaattactttggcaccaacctaataagctctttaagaaagcttagtgagctacaagaaaacataggtagctaacccaacaaaatcggaaaaataatacatgaaaaaaatgagaagttcaataaagagatatcacaaaaaagaaccaaagagaaattcaggtaatacagaattcaattaatgaaataaaaactgcaatggagagcatcaacagcagacaaaatcaagcagaagaaagacttgacttctgtggacctgaagacaggtcatttgaagacgtccaaaagtctctcaagtcaaaaacaaaaagaattttgaaagcaacagaaaaggaaagaactttttaacatataagaaaacccctatatggctatcagtggatttctcaggaagaacttcgtagtccaggaaagaatggggagatttaaaatactgaaagaaaaataaaacctgccagtcaatattttatcctatagtagatacataaaatgagaaaagaatcatagcataatactgtagaacatcatcaaatcacaaagagacagaaaggaacaaagggttgacaaggtattaacaaaatggcaatagtaagttattaccaatcaataattaccttgaatgtaaataggttaaattctccaatcaaaagacatagagtagataaatgggtaagaagaaaacactcaaatatatgctccctactcacttcagtttgaaggactgaaagataaaatgtctttaaggactgagagagcaaattaagttttaaagacaacatagactgaaagtgcagagatgaataaaaacattcaatgtaaacggaaagtaagagcagaggtgtttatacttatatcagacaaaatagtttttaagtcaaaaactaaagagagacaaagaaggtcattgtataatgataaaggggtcactttattaagaagatatgccagttgtaaatatataagtactaaacatcagaacacataaatatataaagcaaaagatctgagggaagagacagacagtaatataaaaataatagaataaaatttaatacctcactttcagcattggataggttatcccaacagaaaatcaataaggaaaagtcacaattgaattacaatttagaccaactgaacctaatagagatatactgaatattgcatacaacagttgaacaaagcacaccttcctcaagcacatgcagaacattctccagcatagattgtattttaggctacaaaaaaagtcttaacaaacttaagaagtgtattttctgatcacagtgttataaaactggaaatcaattacagaggaaaaactagaaaattcacaaatatgtggcagatctaaaatatcataactttgtacctcaaggaactagaaagagaggaacaaccccccccccaattagtagaaggaaataacaaagaccagagcagaaatgaaggaaatagaaactagatgaacaacaaaaagatcaatgaaactaagagttggttttttaaaaacatcaacaaaattaagaaagctttagctggactaattaagaaaaaagagaatattcaactaactaaaatcagaaatgaaaaaatacattacaataatgtgagataaattagaagaacaattacaggagactattataaacaattatatgccaacaaattggataccctagaaaaatgaaaaaaatcctagatacaacctaccaagaatgaatagtaaaaaaaaaattcttactcaacatagtactagaggtcctagccagagcaattgcacaagagaaaaaaataaagggtatacaaattggaaagaaggaagttagattgtccctgtttgcagataacatagtcttatatatttaaagaaatctaaaaacttcaccaaaacctcttagaactgacaatgataaatgcagtaaagttttgggatacacaatcaacatacaaaaataagtagcatttctgtatactgataatgaattagctgaaaacatttcaagaaagcaatttacaatagctataaaaatacctaagaccaaatttaagcaagaaagtgaaagatctctgcaatgaaaactataaaacactgatgaaaaaaaatggaaggggacacaaagagatggaaggctattccatgttcatggattagaataataaatattgttaaaatgactgcatttccccaggtgacctacagattacatgcaatctctatcaaaatacaaatgacattcttcacagaaatagataaaactatgctgaaaatttgtataaagccacaagccatcttgaatagagcaattctgtgcataaaacaaagctggaggcatcacatgatttgacctcaaaatatactacagagctatagtaaccaaaacaacatggcattgacataaaaacagacacataggtcaatagtatagaatataaaatgcagaaataaatccatgcatttacagctggctgatttttgacagcagctccaagaatataaattggggaaaggacaggctcttcaacaaatggtgctgggaaaactaggtatccatatccagaaaaatgaaactagatccctatctctcaccatatacaaaactgaactcaaaatggatgaaataattatatgtcagacccaaagctattaaactactattaaaataagttaaacacttcagaacatttgtttgggcaaagattttaatggagaatagctcaaaagcacaggcaacaaaagcaaaaatagacaaataggattatatcaaactaaaaagtgcctgtgtgacaaaggaaaaatcaacagaatgaagagacaatctgtagaaggagagaaaatatttgcaagttatttatctgacaaggggtaattatccagaatctacaagaaactcaaaaaaactcaacagcaaacaaaaagaaaaacagataataataatctaattttaaaatgggcaaatgatctgaatagacatttctgaaaagacataggaatagccaacatgtatctgaaaaaatgttcaacatcactaatcagggaaatgcaaattaaaatcacaatgagatatcatttttctccagttagaatgactactaacaaaaagataaaaaataaatactggtaattatatcatgtgcattctgtaaattaaattttgttttttaatttgagtgatagagttcacttttatgttactgaactggtttccataatcatttgattcagatcttcagatatagtagaaatgtgaaactgttcagtgacgggtttctcatttatataatgccaaatctaatttaaagaccattttcactgaaataaccattttattgagtatttttacataatattaaaataattagtttaaccagaaaactttatcaacacatttgaaataattttggcttacgatacgtataccacttgattgaatttcatgcaacttcctaatggccgctttgatacagcataagtataatcactaaaagttacctacaaaaatgctatcaagactatattcaatttgctagaagatattaatagaaggatatttagataatacaataagttcacatttgacttcatttgccaaagaaatatttaaacctgttaaatttgtgagtaaggttttatcaattcagttgtgtttaataaacatttagtgagttcatacccatttccagtaatgggtaattttaaaaaaatactttctctgaagaaattgtgtagcaaaacttaatatagctaaggatatagacagagattttaattcaacttttttatttgtaagagaagagattgcacagaggtgaaattgcttataaagggcttttcacgtagaaggcacagacgcaaatcacagaggtgtgtgaagatgcacaggacaactatcctggagagattaaagtgcaccttattttccatggcattttcttagccctactttttggatccttaaaaaatcagttctttttccatgattaacttttttatgtttaaatttactttgaacttagtttccaaaaaaattacacaatattaaacttattagtgttttaacattacatttggacctaaacaaatttaccatattattgtgtttttttaagtcattttagaaaaacgtatatcttttggccaggcgtggtggcttacacctgtaatcccagcactttgggaggccaaggtgggcagatcacgaggtcaggagatcgagaccatcctggctagcacggtgaaaccctgtctctactaaaaaaaaaaaaattacaaaaaattagccaggcatggtggcgggcccctgtagtcccagctactcgggaggctgaggcgagagaatggcgtgaacccaggaggcggagcttgcagtgagaggagatcgcaccactgcactccagcctgggtgacagagcgagactccatctcttaaaaaaaaaaaaaaaaaaaaaaaaagaaaaacttatatctttttagatgacaaagcaaatgacaaccaaaacaatgataatacaaatcttgctaatgatggcctattcaaactactttctaaaatcttcctgtagttaaattttaatgaaatcaaatagaaaagaaaaaggtaacagatcaaaattctttagatttgagatatgaatgtcattgaattatggcttcctgataggtttctttaagcccctgaatataaattgttattttcacatctagaaatcgactgggagtcaggaggatatctaacaatgctaccaaagtccagttatgggatggtgcttataggaacatactattataggtagtttttaattattattatatttagttatataagtttgtgagtacattagttttctgttgctgcataacaaattaccatagacttagtgacttaaaatgacacaaatttattctttcacagtttccattttctaggcccattatctaggtttcactgggatgaaatcaaggtgtgggttggagactcacaatctacttccaagctcactgattattggcaaattcatttccttgcatttgtaggagagaagtctttgtttatttgcttgcttgttttttgttttgatgactgtcagctagggaccactctcagttcctagaggtcacctgcagttctttgccatgtgcccccctcccccatagacaatttacaacatctatggatgtttgctctccttcaggccagcaggaatgcatctctcctccttctccctccagtcaactatgacccagtctgatgaaaattagcataatcatgcggatgagcaggccatgatcttttgccacataacttaacctaatcaaggaataaccatcttactacattcataggttaacccacattcaaaaggagataattatgtggaacaggagttccagggagcagaaatttgtagaagtatttcaggattctgctgaccacagtgatatacatattatttccattttacagattagaagattaggacttagaaaggtttagtaattgatttgcctagattgatatggctaatatgtggcggagctaacagctgtctaatttaaaagctgggactcataaccgttatgtttaacatcatcttgtggcctaatggtaaagaaattaaattacccttaatatagttaatccactttcttagtttccattcacttgtctatacagaagacttaaatttatctctctaatgttgaggacttgcttgagctatagtctcctatctcttaaaatcttctgcaattttctaattttatgacctagcttaaatttgactcatccaaaaccaatttcaagaaattacccttcttaaagtaccagtttctattaggtgtgacaccatttttcttgcctgaattgccatctttatgcctttttctactttgcagcattatggactaataaagggctgatatcccagtacccatcatggagctcatctatagacagggcttagtcaatacacctgtttttgtttggtactcaaggctagtcagtaaccaatgcttttattttttaatttgaaatattaagaacatttccatctgttttgttttattactattagcattatatttagtaatgataatgtgtgatttacccttattttgggggtagcacctttttttagttatttaataaatatattagctgttttccaaatgctgcaaacatgcacagtttaaccttgcttgaagtagcacttcaagtgcatttaatttacctacagatttaggatctaatagtgaaaaattagtaaataaaaatgaattgtagaattgttgccaccaaactgagattggaaaatacattttaagtattaaattgctattaaatatataagaaccactttcatagcatagcatgaaatcttccctggaagaatactgcctttttattgcttgtggatatgaattagtagagtaactcattagatatactttctagccccagatttctaaggaaatatacccataaagatttttctaaggctactattcactgatgtgaataaatatacctaatacgaataaacattttatggtattaagaaagagtactggggagtggttaagactatggagcctagagccagactgcctgagtttttatccccttgtctccatttactagttgtgtgactttgataagatgcttcaccaatctgattcttgattttcttatttctaacaaggaatattaacagcatttatctcattaatatgttaaaaaaatgaaataatattttaaagaatttgagaacttgtaccttatcactgctaaacaaacaaataaattagcagaatatttaagatactgtaaagattaattcttcgtagactatgcaaatatagttgcattattgggatctttaaaaatattcctttaaaacattagatttatgatgcaaaaagtaatttagaaatcgttaataataataaatgacccaggataaataacagaaatgcttacaaagcattttttttttgaattttcagtgttatcagtgaatatttattgaataccttgtatattgtaagtattgtgggggtacaaagagttacaatatcatgaaactattgttttaaagaatttacagtctaataacagtaatagggtgtgtttataaagacacagaacctggtagcatatgctttttgaagctgaagagatatctgagctctgatgcaaaccagcatcgtttcttgccaagatttttgtttgttatcctgaacagttaggaggcaaatacatggccacagtcaacatatgcatattccattcgagcatagcatttaaccttcaagacaaagcattttttaaatagagaaaacaaggcctcatatagttactaatattatattaaaaatactatgttatctctcattttatattattaattttcctgtatgaggtcaaattttcatctgggagcaaatttcttaaattgattcttttagttgacatatttttgaagaattttggctaggtagtttaatttctctaaacaagcatgggtaaatgaacgccggaaaataaaagcaaatctatttgtgcataagaaagactgcagcacaggaggtgtgagacacagccttgatctgcaccttttagcaatcttggtttgggagaaagacagctttatcgttcctaactgccagctctgtacttggtatgagttggatatttttcagattaaatcaaaaggcaaaaattgggtcataaattctatggagttctgttcagggaaatatactgggaaacagggtgagatggcagccagaaatgtcccctttagggcctggcagaaacaaacaacgagatataaatacaaaattaaaattgatacaattacattacagagttattttagtctcaatatccccattcaaagattgtgcctttggtttaaaagttaccagcagcaaaattttgcagagttcccatttccaggctccagtgaaaattctttccttgggctcagtacatccataagggatttgtcagagctttctaattttacaactattagataaaatgataaggcagctgggtcactggaaggcgaagcatccaaaccaggattttgctggcttaaagaaaataaaaatgatgtataaaatagcaagccccacggaacaatataaagaaaaggcagggaaaagtgtactgctgtaaaagatgtttaaagcaaggattcttgtagtgtcttattttcatttgaaagctgtagccgggagcaaagattcactttgttttggcaagttagaaatatttcactggtttttatttttactcaaagtaagtacaagaaacatactgataatatgagattcttcttactctctctgctccacgttctggccttttctttatgcttggatactcctactctcatctactttatcttctctctaggggaaagttttggaaagctggctagaaacaaatgaaaagtaagttttccctgagaagtgttaaatatattgctctaagcatccagtgtaacatatggatctgacctctgtgggatgtgaaccaaatatttgttgactgagtgatcatttctacaggccggaattttaacacaacatttgatgttggagttactgcagttcagtggaagacaaatgtttatgccatatataattttgaaaatattctaggctccccctagaccatgatttatgaattatttcagcagcttgttgtagagcatggccaaaaattttcgtgtgttaggtatttctagaagctgaatcaatgaagcaaatttcttgattactggtatgttggaagaaccctaatcattgtatcatataaataaaactcttcaaataatcaaacataatcagaaattcaagtcagcatgacattatcaaaaagggagttggaagaagtgaggacagaggaaatgagagaagaagatgtgcaaagagcgataaagctgatttaacctcagtcctgagtagtatttgggtttgtgacctagtggatgaaaatgactgtgtcactgaaggatgagatagtcccgtataaaaattcctttcttccagaaagtgattaatgtcatcccccattgaacaaagacaaaagttctgatcaaaatttaaatatagtttggaatatatttctgtggccactctgcacaagcaggatagatcctgactcccattttttttctgatgatgtcaaacacacacacacacactctctgtctctctctctctctctctctcgctctctctctctctcaaggagtaatgacaggtttattatgcatacaaccaggctttctggggataaggcaggcctttcaagtgggtccaaaacatcttgagagtgcagggaaaagagaatggcttggcttttctggtggttagtggatggagttagactgaaggttcccatgcatgggtcagccttacatggtctgaattatgccccgttgtaaaagaaaggagcacttttttttttttaaccaggctttcttaccagcttgcccaattgtaaggcatgaagggaagtggaaggagtgaagtttaaaagtcgtcaactgtcggccgggcgcggtggctcacgcctggcctgtaatcccagcactttaggaggctgaggcgggcggatcgtgaggtcaggggatcaagaccatcctggctaacacggtgaaaccccatctctactaaaaaatacaaaaaattagccgggcgtggtggtgggcacctgtagtcccagctactcaggagagtgaggcaggagaatggcgtgaacccgggaggcggagcttgcagtgagaggagatcgcaccactgcactccagcctgggcgacagagcaagactccgtctcaaaaaaaaaaaaaaaaaaaaaaaagttgtcaactctcaaacatcagagagatggaatgagaccctcgattaccacactcaatataaattgtatcagcccattggtgtatgcacatttgcactattctcttcttttttttttttttattatactttaagttttagggtacacgtgcacaacgtgcaggtttgttacatatgtatacatgtgccatgttgcacaacaggtgctggagaggatgtggagaaataggaacacttttacactgttggtgggactgtaaactagttgctggtgggattgtaaactagttgttggtgggactataaactagttcaaccattgtggaagacagtgtggtgattcctcaaggatctagaactagaaataccatttgacccagcgatcccattactgggtatatacccaaaggattataaaccatgctgctacaaaggcacatgcacacgtatgtttattgcggcactattcacaatagcgaagacttggaaccaacccaaatgtccatcaatgatagaccggattaagaaaatgtggcacatatacaccatggaatacaatgcactattctcttctacatcagttttcctctcaagtctcctcaagatttgtgcactttctgtgactctagcatattgcagttactccagtatcaaatgttgtgttaaaattctggcctgtagaaatgatcactcagatatcttactaatttgttggcattttaaggttcttccaccaaaacatcacgttctgcacatcgtttttaaattcttattttctctgccaggtccagctcctttcttactgaccagagctctatcagcttcttcacacttctcctccttaactgcttatctttcaaagagcagttcaagtcccctcttcactgtcttcctgcaatcatttaggtccttgtcaatgtctgtatatagtttcatttctaaatcccagaaacaactgatggtaataattgcatgtttatatatttacatatatttaaaaatatatatacacatatatttaaatacatatatacacacacacatatctatatacatacatatatgtatgtattcaaatatatagggtgtctgatctattccaggtgcctagtccaatgcctattctaggctccagtaagacatagactctgtagcatggttatgggttagagatgactgtgaaatgctcagctgacctagcataacaagggaactactttctggaagtattcttaaataaaattaaactctgaaaggcaaatgtttatttgaaatatttaatctgtctttcactaggaacatacaacttttaaaactttggtaaactacattactttataaatgcaatctgtaacctgaataatatatcatgtgtcttgtttgtatctaggtttctgaaagcttaaatacagattcaacattagttacatggaaggaaaaagaatctcactaatttacttgaacagtattgtatgggtataattcctagactaagtgacttttcaaatggtagtaactgctatacaatagctacaattacttactatcatctaaaaattataggaaggtaagctgcgaaaattatttttcattggaagatacttttaaccaaaaggttcagctttagttggagtagattttttcccttttattgctgtctaatattaacacaaactaggttatttcttttctctacggatttgtttatattgtgttcaaaatgatttctccatgtttccatttattttgagagactaaaatttataaaaattttcacattcacttgtcttgatgtaaagtaattgcttctattgaaaatgtaattcacaagcttttgaaaataatgtaagctatacttatggctcaagacagagaaaaatagtttaaaaatcaataaactaaaaaacaaatgtatctggggcaatacacccaaatgaaaagcaaagaaagatatctcaggttatcagattcatagagttttgaaactgtttcaaggaatcttgaccatcaatgagagcatggaggtgcttattttccatatacttattatatgggaaaataattagaaagtttaaacgcagcaaagaattgtatctcaaaaaatggtcttgatattttgaaataattttaacaagggatattaaatataacaccagaaatttaacaaatatatttaatcatgaaaattggcatctaacattttgccaatgtcatctacaatcttgagtctcctaggtatgagatctgtctacctaggtcaaaggctattgaacttgggacatctaaagagcttcataaaagacaactttctccaatataatagtaacttctgatgtgtacagagcttattacattgctacacgtttttacctgagcagtacgatcttttatttttagctcctttggatgtttcaattgcatttctaaaaataatattttcattgcacttgcaattttgtgcatcattgcccctaactgcatctttaaaatacatgctgtgaatatttagccctaaagcataccatgaactttctaaaatggagcatgctttgattgctgtgacttcttaattttctccatgaaatgaatatctttcatgtatatactatgaaatcaacaatgctaaaggaagatactatccctcagatggcctgttcagttctaattctcataacatacatattcaacaaaaatgaggccatgtttatctctaatccctaggcaatccctaagcaacagacagaaatgtaagggctgtcaacattccatgatctcgtgagctctaaactgcaagagagaaattttctaagttctataacagaacttatttcaaagatttcttataaaagatacattcccacaattgataatctgtatagctcattcagcaatgttctacttatttgtttcaaagtcaaataaacagtacttattcattcaaaaagtatttattgcatgccttctaagcaataatcattatgctaatgcttactgctcactgtgtatggaagggtctcataaggcacagtaaacaaggtaataaatcaaatgattatacactgtgataagtgctataaaatcaatctcagggctaagatctagaataatagcagtcagtaaagttctctctgagggatgacatttaaatttggcagtgaagaaatagattagagtggtgaggcaaattatatacaaccctctggtcaagtcttgcccactgcctgtttttctaaataaagttttgttaaaacacagccacacccatcattcatgtattgtttatagatgttttgcactacacagcacagttgagtagttggaacagaggttgtatggcctataatttagaaaatctttgcatctgttcctttatagaaaaaattttcacacactaacttccacagtggttgaactagtttacagtcccaccaacagtgtaaaagtgttcctatttctccacatcctctccagcacctgttgtttcctgacattttaatgatcgtcattctaactggtgtgagatggtgtctcattgtggttttgatttgcatttctctgatggccagtgatgatgaacattttttcattttgtcttttggctgcataaatgtcttcttttgagaagtgtcttgtctgttcatatcctttgcccactttttgatggggttctttgtttttttcttgtaaatttgtttgagttcattgcagattctggatattagccctttgtcagatgagtagattgcaaaaattttctcccattctgtaggttgcctgttcactctgatggtagtttcttttgctgtgcagaagctccttagtttaattagatcccatttgtcaattttggcttttgttgccattgcttttggtgttttagacatgaagtccttgtccatgcctatgtcctgaatggtattgcctaggtttttttctaggggttttatggttttaggtctaacatgtaagtctttaatccatcttgaattaatttttgtataaggtgtaaggaagggatccagtttcagctttctacatatggctagccagctttcccagcaccatttattaaacaggaatcctttccccatttcttgtttctgtcaggtttgccaaagatcagatagttgtagatatgtggcattatttctgagggctctgttctgttccattggtctatatctctgttttggtaccagtaccatgctgttttggttactgtagccttgtagtatagtttgaagtcaggtagcgtgatgcctccagctcctcagggatctagaactggaaataccatttgacccaactatcccattactgggtatatacccaaaggattataaatcatgctgctataaagacacatgcacatgtatgtttattgcggcactattcacaatagcaaagacttggaaccaacccaaatgtccaacaacgatcgactggattaagaaagtgtggcacatatgcaccatggaatactatgcagccataaaagaggatgagttcatgtcctttgtagggacatggatgaagctggaaaccatccttctcagcaaactgtcacaaggacaaaaaaccaaatgccgcatgttctcactcataggtgagaattgaacaatgagaacacatggacacaggaaagggaacatcacacactggggcctgttgtggggtgcaggggggagggataacattagaagatatacctaatgttaaatgacgagttaatgggtgctgcacaccaacatggcacatatatacatatgtaacaaacctgcacattgtgcacatgtaccctaaaacttaaagtataattaaaaaaaaaaagttttcagatccctagcagtagatgccttccgaacaaagaggggagaaggagcattccatggagaaggcataacaggagcaatgccacttagagcaaaatacaactaaacatggcatattagagaaactgaaagaaacccaggtagcaagaggtaaagtgggaggagattgtgggaaccaaacaagctatgctgagccttggaggctgtggcggtgaacagtgtgatttatttatttatttatttttgagaaggagtctcgctctgtctcccaggctggagtgaagtggcgtgatctcagctcattgcaacctccgcctcctgggttcaagcgattctcctgcctcagcctcctgagtagctgggattataggcgtgtgccaccatgcccggctaatttttgtatttttagtagagacagagtttcaccatgttggtcaggctggtcttgaactcttgacttcgtgatcctcccccccttggcctcccaaagtgctgggattacaggcatgagccactggacccggtgtgaatttttaattctcatgattacacgaagccattggaaagcttttagaggggagtgacgtggtatgatttatgttgtttagagattttacagctaatccttatggagtatttactatgtgcacagttgtaagtcatttatatgcattgatttatttaaaagtcttccatattatgaagtgtaattgtaatacatagtttacaaagaaaagcaatgttgcttgctcaaaataatgtgatacacttgcaaatcgtggaggcaggattggaatccaaacagttgtcatgtagagtctatgctcttaaccattaggctgtacagcctcacattgcctgtggtgtacagtatagaccatgtgacttgtgtgtgggggagcagtgcggggagtacagtatgtgtgtgtgtgtttataaaagcaggaatatgagtaccttaggaactgtgaaaatagtaaaagtgtagtagatggtagtgacctgagctgtgagactgaatatgcagatgaaaaatggctgactttcagtaaagaagtagtcgcttacattcagtgctgacaagtggtgaagtgggaagtagattgaaaagcatggattcgattttcagccgggagactcttgctgagagttacacttcaaatagtaacatactactttgcagaaatcatacatggtgccatagactaacaaggacaattgcatttaaccctgcaattaattctgtttttccagaagagtaacatgaatatgactaaactatgtatggtgaaggactattttcttcccgagccttcatttaatttttttctttacaatttaccaaactgctagccaaaatagtattctctatttatagactaaaacttttcagatgattaattttgttgtataatgtattcatttttatatttcattatagttgtctttctctgagtaaaatacctgtcaatgatgttttattgtataagactaaattatgttcttgaaactagatgatttgctttcatatacagatcaaaaaattcctttgttagtattaaaagtaaggtataaaaggttatatacatttttaaaaatataaatggcctgtcatagaatatactgcgttaaaataaataacttataattgaatataatgagttattagttatcttggtgaagggacagcagttgaattatcttatttaggaacaactatctccagtaatctttggattaaaaaggtccaaaaatgcttatggagacagtgtagataatctaaagattatctacaatctttagagataataaattttaaaaatcaagaatctcttttcttgcaagagttcatgtgtgccttttcttctttgaaaagagacatagcatagcttaacataattattcaacattataaatctgagtttaattatagggtgaaagaaagtgtctctcatgtaagaagacaattacatttaagttatgatgattaaaaatatccacaacccagccttagcctctttattccaaatctaaatatacaggactcttaaaattatataaatatttaaaaatattcagtatattcaatactatttgtctagtttttaaaaatttttatactttgcaataaaataaaccaaagaaacaaatataatacaaatgaatgttcatatatttaatacttgaagattaatacagtagtatacaataggcagaaataagtaactatcataaatttttcatataaaaatcatgctaaggtatatataaatgtggattttcactatagtgtaccattctgtttttatgtttatatgtaagtaaaattgaatgtactacgtgtaacttagtagacattactctacacactgattatatgttttgcattttacttttgtgttatcattctaaatcctataaatgtttcatactatgacaaagggcagataaaatattatattaaagtcagtctcaggaaggaataattagtattttttgtaacaaaaaaggatacaaatctaattttgatttttttcctcatattaacttatccttactcttgttcacattttttatttaaatattaaaaatgcaatcaagctcatacatggacattttttaaaatgtcaggtggtacaagaaagcttataaaaactagcctgaagaaaggtagacgttcccatatctcaggcttactaacattttcagctttttcatctgatatctccctacatatctatagaaatgtttattgattatttttgttacactaagcttggcattatctgtgggttttctaagatagaggagaacttggctttcttttgcattacttcacacacacacacacacacacacacacacacacacacacagagaaatccatttgtattggtttaactatgtcaatagtgctcattgcaaatacagagatcgatttatatttatatgcacacatgttttaatgatgttttaaactttattttctccatatcttgtatttttaccattattcaattatcagttactctaccattaatttttctatgctacccatatatgtatcttttccctagaaccatttctcctagagctttccttctgtttgcactgctgatctctgggcctaactaaatagctcttataagaggacttgccttcacaaatgggtttccctattttcctggattccatatctttctttttttttttctttctctttcctgaggtttatctctaagtatcccctaaaggatgactggggtgagagatggttcttatatacgaatgctaagggaagcttctctgaagtggtgatctttgagctaaagcttgagccatgcaaagatctaggaagagtgaatagttagataaaaagctcctaaggaagtgtgtgctgtggatgtcagttatagcagggagggtagagcctagcgtcatggggaaactaaaagtggtacctaacaaagtgtgagatttattgaagcaggatcagggtcatcttgggctttccagtccatgataagagttttgaaatttatttttacttcactaagaaactactggccagttttaagccaaggaatgataagagctatttttataataatatagaaatgatgaggaaggccttttcagtgacctgcatttcttcatcttcagaataataaagctggtggaatagatggaaaaatgatttagtatttcaaatctccagactaaggagatagatgtttttagcaaaaaaaaaattaataatagcaaatactaaaaaggttatgaagcatgagggctctaaaaaatatgtctagtgaaaatatatacccagattagggaatacacaaatgatgaagaaatgaatacaaatgcaggaaataatgtcaaaagttttgacgatggattagagggcaaaaaatctaaattcgaacctgacagggaagtataattaagaagatgtgtgggaatgtagatatgaagaatgttggtgtggtggatggaagggaagcaagcaatagaaagaagttaaagacaaaagtagcaaatatgagaaaatgggaacccagtgtctcaatacaattcagagtaaagatcgagattcagcctgactaacgaggagctctgcatattgatctagagagattttgagaaaggaaggacagagggaaaaacagatctccatcaggtaaggcgtgaggttgacaaatgtctcttattcatttcacaaatacctatgaacatctattttctgggcatatgctaggtgctatggatatatgatgagatgcattttgtgttctcaaaatgttcataactagtaagaaaggcagaaagttaaatacatttttcattgcaatagaagcatctgcaagacaatatgcgtatccaggagtagcctttggaaccgaacctgtggtatctctgggatatacctcagtctttagactaaagtaaggagctgagtgagggtttcatagagtaggtggtgatttcctgattttctggagaataagtgagtacttaaatagtaggcacagaaagatgcagagagggaattctcaacagtagtggtgcttttttttttaacagaaaaacaaagttagacattgaaaagtaaaagtttctcagtatgggagatcctcaagaaattcagaaagtgattataaacaaagaatagatcataaactactatgaacattatgctgtagtgtttaggtattacaagacaattgcacatatgatcaaaattttatttagaaatattcctgtgatcaaaacagagggatactttcaggggtgagtgagaagggatttaaatagacactataacactatggggatattttaaaataaataattaaacgagtaatgggaagggagaaaagtgtttggataatatttaaacaagattaataggacttggggttgcttgggtgtaggtgaaactgaccttaagaaggagtacaggcatacttcagacacattgtaggttcaattccagaccactacaataaggtgagtctcacaattttttaggttttccagtgtatataaaagctatgtttacattatactgtagtttaagtatgcaatataattatatctaaaaacagcatatatgccttaatttgaaaatatttcattgccaaaaaatgctcatgatcatctgagcctttagtgattatttttgctagtggagggtcttgatgttgacagctgctggctggtcagtgtggtagtttctgaagattgggatggctatgggcatttcttaaaatgagacgtcaataaagtttgccacattaattgacttacaaaagattcctctatagcatgtgatgcagtttgatggcattttacccacaggagaacttctttcaaaactgcagacagtcctctcaaaccttgccactgctttatcaactaaatttgtgtatattctatattcattgttgttatttcaacaatgttcccagcatcttcaccaggagtagattctttctaaaaaaaaaaaaaaaaccaccttgtttgctcttccttaaggaacaacttcgtatccattaaagtatcatcatgagattatagcaagttagtcacatcttcaggctccatttataatcccagttatcttgctatttccaccacagcagaagttacttcctctactgtagtattaaattcctcaaactcatccatgaggtttggaatcaatttcttctaaactcctgttaatgttgatattttgaccccttcccatgaatcataaatattcttaatggcatctagaatggtgaattttttccagaaaattttcaattgactttgcctagattcattggaggaatcactatctatggcagctataaccttacaaaatgtatttcttaaaatataagacttggaagttgaaattaccccttaatccaatgactgcagaatggatgttgtattgtcaggcatgaaaaaaaattaatcaacttgtaaatctccgtcagagctcttggatgaccagacacatttgtcatgagcagtaatattttgacaggaatctttttttctgagcagcagggtctcaatagtgggcttaaaatagtcattaaagcatgttgtaaacagatgtgccataatctaggctttgttcttccatttctagagaacagacagagtagatttaatataactcttaagggccctaggatttttagaatgataaatgagcattggcttcaacttaaagtcaccacctgcaagattccctaacaagaaagtcagcctatcttttgaagctttgaagccagaaattaatttctttgtagctatgaaattcctagatggcatcttctagtagaaggctgttcaatgtacattgaaaatccattgtttagtgtaacgaccttcatcaatgatcttagatacatcttctgaacaacttgctgcagcttctacatcatcacttgttgcttcatcttgcacttctctgacatggagatggcttcttaaacctcatgaaccaacctctgctggcttcagacttttcttctgcagcttcctcgcctctttcagccttcatagagttgaagagagttaggcgttgctctggattagtctttggtttaagagaatgttgtggttggtttgatccatctggaccaaactttctccatatcagccataagcctatttcacttgcttatcattggggtgttcaatggagtagcacttttgatttccttcaagatcttttcctttgcattcacaacttggctaagtagtgcaagagacctagcatttgacctgtttcagctttcaacatgccttcctcacgatgcttgatcatttctagcttttgatttaaagtgagagatgtgtgactcttccttttacttgaacacttagaggccataataatagggttattattttgaattggcctaatatcagtatcattatcattgtgtctcaggaaataggcccagagaaagagagagacagagagagagaaaggagaattactggttggtggaacagtcagaacactcacaatatgtatccattaagcttgccatctcatacgagtgcagtttgtgacatcccaaaacaatgacagtagtaatatcaaaggtcactgattataaatcagcataacatatactaatactggtaaagtttaaagtatgagaatcatcaaaatgtggcacagaaatgcacactgttgaaaaaatgacacccatagaattgctggtcacagagtccttactttgtaaaaaacaaaaacaaaaacaaaaaaataacaaaactcagtatatgtgaagcacaataaagtgaggcatgcctgtattggatgaaaactgccagattttaatattaagcaatcgagagaatagtgactttaagcacttagaaatgataattaatgtcaaagccaaagcgagatgaagcaagaaaaaggctagcgagtgtcgattggattgaccattcctaaactcaagcacaatttctgtgtctgttgaaacagaacttcaattgtacatagtagatgtaaataggtgagctgtaagtcgtagacgaggaagggttgacattagaaagctggctagaaaaagaaaaagaggaatggctaaatgggaacataaaactcaaaataatctttctggtatacctattttatgaagacggaaaaatcttgggcatttgtgaagtgagaaagaaacaagatattgggaaaggagggtatataacacagcaaagtcttggaggaacagagaaggaagggttggaactcagaattcacacaaagatagggcattcattccagagacagttaggacatttcattttcaaggaataagagggcatataaaacaatagctgtaattacggatatatgtggggtgaggagagtcaagagagtatacttcttatggcttctgtttcaattgtgaattcagaggcaaggcaattaaatagggcatttgggagagtgctgctgatttagaaccactgtcccaagaaaaaggaaaaaaccctagttgactagagaaaataaaaagcatcctcataattgtgctgttttttcaacagcactgagcagcctgcttgtacaagtggaaaattcacatataggacatggatagcatcaaatgagaggttgactgcttcaagttataaactatttgagttattatgatgtgttaatgttggcaggtaagaaattaaaatccgaagcatgttgttagacttttatgcctagtgttccattattggaatgctaagcatgggagagttatttatatcctacttctcaaagatacctccaaagtctgattgcaaaaattcaaaaaattgcaacctcaggcataattgggttaatagactgggttatctaggatctagataaagagttggcctggggatgggagttccaggaaataaaacaggtacagcatatataagttttaataccaactctgaaaagaaaagaatttgagaaggctgataattttggcataatactataagaaaatgtatggaaaatcaaggagagatgaataaaaagtcttcagaacataaaaatagggttgaaatcctgaattcatgttcacccaatatatgcattttcatcaatttcccaaagaaactttggcaactgggaagtggtcatagggagtgtatcctgaactaaggactttaaaggggagatataaggagtagtcaaagaagacatacattctagtggcagcaagggctttcttgagatggttgattaccatgttcagcaggtggagttaggtggctaagaaatcagttataattaaaaatatttttttaaaaaaagaatatgaaagacataggtagtaagttatagtcagaaagtgatttctgatcttgagattttagttttgaaaagctccacatatttaaaagggataagattttgtcactgaagtctaatgtgctagaaaggttatcaatatgggcattgaagagttgagcagagatggcatagagttagctgtattaaatatttgataagtaaataaataaatgggaggctgggcacggtggctcacgtctgtaatcccagcactttgggaggccgaggtggaaggatcacgaagtcaggagttcaagaccagcctggccaagatgggaaaaccccgtctctactaaaaatacaaaaattagctgggcgtggtggcaggcgcctgtaatcctagctacttgggaggctgaggcagagaattgcttgaacctgggaggctgaggttgcagtgagccgagatcgcaccactgcactccagcctgggtgacagagcaagattctgtctcaataaataaataaataaataaataaataaataaataaataaataggataatggacaagtgcttggataaatggaaagtaaataaaaggcattagaaacactgagtgtaaatggtggtatttggaagttgtataatgatagcaatgagaatgaaaaggggtggtaattaatatgaaaaacagaacatctgggccaaaatatattctattcctggggtaaccccccatctattttgtctgaatgtttatattgattaataaacctgaatcacaaaattatattctgccaatatctgtacatatctaatagtgagaagccctatatgattatttcttagctttgaggcttttgatgatactgaattaatttcttgcttcacagaatatttaagtgaaaattcttggtgtggtttattcacacagcatatgatgtttaatattagtagttctggtggatactttgtgttacttcttcagatgtactctcaatctatttccacctgcctctcatcccaaggaggtggacctgtatggatttcaatggagtaatattaccttctgatgaccatctgagttcagccaatgagcaactctagcaagagatgagtgggaaggagcagaatgagtttgggctgtgtatgcccccagcttcattcctgtatcacgtcccctgctaggttggattcccatatggaaggtcgcgggtcctctccaggcagtcctttctacacagctggctctctcactataggttttggcaactgctgactgccttctccccttaggcactgggaatgataaaaagctcctctactgttaggctcggcattccccactctcctttatggtttctctactccttggctatacagtcctaaatactccttcatgaaaccatcctcaaattttcctaatttgagtgtgccatctgtttcctactgggaccctgactcaggcaaaatcaaaaaaattatcaacaaccttgttattaacctgtgtaaaaatgtgtctttatgaccttgcaatattttctcatatactacttttaccatgtatcactatactacattttaaagatgcatttcattggattattattttataattttcattcccattttaagttcatttagaggaaggcaaactcccaaatataaatgtagctatgtctcttaattcgtttacactaagatccttggtagcacaatactttattccttggcttgtgagatacctagagatttctagagaaattcttcacatatagatatatgtgcccatctttaaaaatattttagacaatgatgttggttggcatggctatgttgaattgctaacaagccagaaggcttttgtcctggcaggaataaagtgatatttgatcacaggatgcagttttactatgaaaagagagaaatcacttctcagaagctctgagttaaattagaaagcaggttgattacttttaatactgcagatgattgactagaaacaaagaccatgtgtcagaacaaaagtgttaatacctgaaacagcctctttttttatttttatttttttgccaatgaacaaaaatgactgcttggaagatcattaataggcatgaaaataagcccttttaatgtaatatctttattccaagttgaaattcactgactgaaaaaagtatttaaattcataagatataatcatataagaatggtatttctaatttattcctaattggttttaatcagttagcatgatctatagcctaattttaatttataaaacaatgagcaatatttttcttcactgtaagaataatattaaacacttagatctttaaaaccagtactgactgtatagtggtgttttatgtgtggaagtctagtttgcatacttgccgcatatttatactctccagtacactctctcccccacccaaatgttcactggcatgcccaaggcaagttttcccttcataatcccatgtcaaaagccagaatgcatgtcagtgaaactaccaaccaaagtttgaatcagatatattcagatttgagctggaagtgtaatgttttcatcagctaatactggccttaggggaggaaggagcaaagcagaccggacaataagtggtgaatgcctaggagtcctcgaggtggagagaaaaagatcttcctcaagagggtcattgagtaccatggagggatcccatgctgaccgttacctctgagcagccccccgtttatggtcttggatacttgaagagtatccaataattaaagaaattaaattatagtgaagtataataaatagtctggtatatatggaaacacatatggctctttactacagatgggatatgtcaggaaagtctttcaagcagaagtgaactataagctgagttctgagaaaagggcttgacttagccagaaaagtgctacaagaccagcccccaaaactggagcctcatgttcagagccagagagaaagggaaaacatggccaggtcagtgagaaataagcaatgcagtgcctctaaagtatgaggtatagcagtcagtgcagaaagggaaaacgagaagtatttaagaatggatttggccaggtacgcaggaaccaggtcatagcacacctcatgtttgctaagtttatagaaggccatcagggattaaggaaaggagtcatgatcaaccttaggatccagaatgaattccagcagtagtggaaggcacacattgtttggttagaaaaatagagtttgataggaagtgacagaactgttatgttgcttcacttcaagcaggaaatgatgagagcctaaattagtttaatggtggtatgggaaggcagtagaagtgaatgagacaaatctcagacatgttcaggagacaagttacattgaatatggaggtaagagagggaagaaatctagactgactaccgtgtttctgaggaggattggtattcactccagtgatcaatggattcagtaggtaaattgtttaaaaaaatgtggtatatccaaacaatgaatattattcagtgctaaaaagtgagaaagccatgaaaagatgtggaagaaatgtaaacgcatatcactaaatgaaagaagccagtggaaaaaggctacatgctgtatagattccaactatgtgatattctggaaaagcaaaactatggaggctgtgaaaatatccgtggttgccaaaggatgatggagagagggatgaatagaccttgcacagaggatctttaaggcagggaaactactctatatgatactacaacagtagatgcatgtcgttctacatttatcccaatccatagaatgtgtaacagcaagagtaagcactaacatggactatggactttgggtgatgatgtgtaaatgcaggttcatttattgtaaaaaaaaaaaaaaaaaaaaaaaaaagtatcactgtagtatgaggtattcttagtagaggagcttgtgcatatggaggaataagaagtacataggaagaactctttatattttgcattcaatttttctgtaacctaaaagtgcaattaaaaataaggtattaaaatacatggctcagattctgggaagtaagttcaaatttgagatgtctttgagagattcaggtggagatacccactaatgaatgggatttagtttctgcatcacagggcagaaaactgggtctctctctccagaccctgtccccagctcctgggcatggatgttctcggcttatcagccagatgtgtcagccacagacacatgaagaaaagtcagggaccacagtctctttattccacaaaatgtttttgaccctgccaataattagctaagccaaaatgagtttctggtatatatatagtcaattattcttaattaactgccatcctttggagaacataaaggatatttatgatgaagatttctgtgtcatctttttcttttggaagtcattggggtatccccttttgagcaggttaacttctgaaatgtattttgcttgggatactgcaagttctcattatctcatctaacatcaaaagcatgaaaacagttttcagaagtgtgttagacttaagaatttcaggggtttccagctgagggaaaggaattcccaggcatgtacaacaactcattaagctaaatgaattgctaatgctggggtttgctatggacgcagctttgactgcatctgtcaggctggtacatcttttcacttcactgaagagtgttataggtctagaattatgccacagcaagccagaaagtgggtattatgagacaaatgacattactttttttgtactttgttcatgcttcagactaccatattgcttcactttttgagattaagaactagttaagtttcacaaagccatgactagaaatatttaacatgttctttagccaggttagagaatgaaagagaaaactcttccaaaaggaaaatagcttcaataatctttctgtgtgaccactggtcctgttttatgcactatacttcaatttgctatgaagcaagtgaggcccagagtgtgcttggaggcaggcaccctaatcctaacatgctaacttaggactctgggacctttgctgggaacttctcaagtcacagcacttgttttccacgttctcctacatggtgtgctaccccgtcagctctgaagcatgaaagtgaacacttgtttctgctgcttactgaaactccatcctttctccaaccccatgttatcatcctgggtcctcacactacagccagggagggctgggaagaagtgacaacttcagttgcctaacttctattaggctgtgaaacacatatggtcccatgatgtgagtaggtcgcgcagaacaagaggggctagctggccacgtgttggggatggatggaaaaaatgctctttttttccaaattttctatgatactgtgaacaagacagtttctcaataaggggtccttctgtgcacatgtttgtgtatctctagctagcaagctaactatctcactcagagaaaggtttgcttttctttttcttttggtggctggatatatcagttttatataattttacctgataaactacttattgttattctatgaacacaaaaggatgataaatttgagggatgaaaatttgacagcttctattgaataagaagcatgattattttacagaatgttgttacctttagactaatatagttccttgccttttaattttctttttaccatatttctctatgcttttgttttaggattatacattaagcagctgtatcatcagtcttaaacatacatgatgtaactgcaaactgacaaacattcactaattagaagaaagactaatctgaaatgcacacaaaatgcatggaaagaaatgacttttttaaaatgcaagcaacactttaattggacaactatagcattactaagcagtggatctacaatgacacttagaaataaaagtgtgattaccatgttcattatatgtaaaatgtttgaaaagactgccactttattttattactctcttaaaatcctttatttgtcaaattctttctttagtttcacacccatatatgaaaaatcacaagtgccaaatgaataaagctttacttatcctcttgttgcatttccaattcactctctagaataagtacatgcttaaaatttaaaaccttatctttttttctttactcttgtaagaaagttctacatgcatttttaaattaagattttaataattgagcgaaaaaataaaaggtttactgtatgacttcagactacattttccacacggaatgcaaaatagtaccataggaagatctgctcctctttattcctctttctcttccagtcttgctgtcatccaataatgacttattaatagccatgactcaaggtgaatttatcataaagctcatgtagcttaagcttcagggctcctaatttacactgagcccttccaaggtcctcagaagagccctaccaatgtgttcacatgaccttatgtttttgtcaagtcttctaaagtaagatagtgtaactctaacttaaaatataccatttttttttcatgacaaagtcttctgtcacagttttcctcgtgttgtataatcttgaagtggccacaactgtggggacctacttaagggcagttcagctggaaatacattttagtttggattcatgggttatatttatgagattcacagtcacttgtgaatataattagctatttctagctatcctcatataggaatgaatttcaggaatattaccatccattgtactcactcacctggtattatgatgaggaattacaaatagaaaagtcatgtcaaaacatgaatgtgtcaccagaagtgtgtgggtttatttaagattaatcactgcacaagaacacgttagccttgaaattttactataacatatttaaaagaaatattagaggctttccaaaatttgttacaatctaagtttggcttgtcccaaagcagaacctgaggcaagaacttgagtatagtttatatggaatgtgattcacagacacaggactgaagcagcaggggaaaagggaagaaggaaaagcacatatgggtatgccattgaggattcttctatggggaatgcaggcttgggtccaccagtactttgaaaagtgtaggacatgcttctcaaaatcagtctaaataatagaaggctgggacatttactgattatttctgtccccaggagctgttaatttccctccactccagctaagctccactgagttgaacagcaccatgggagatggccctaaaggagaaaagtagagaaacatctttgaggtgggacactggaagctgactcagttgtttatcaaagttaggactgaaattagaagtgagcctaagagatgcaacatggaaaatttaaagcatctaatgggtaaatatttttatttccatttttctgatgaaaaattcgaagttcagtgaggctaggtcagttgcctgagattgcatggaacataggtagtagagataaggtctgaatgtgcatttgtctgatgccaaagatcattcactttccaccacatcacatgcttccttagggagatcttctaagtcaatgagtcatctacacttgaccctgttcagtaagatgaaattgctgacttgggctgatgggagcagatgaagctaacaggatggtcaagtactttgctattcttttttttagtatctgccgttgggagatcaattgttcctggcacttagaaaaggagatggtagaaaaggagattgagctttgtgaacaaatcactaattcacatggacctattgaacaccctgttttagaaggtgtaatacaacaagaaaaataattgtgttgtaaacccaaataaaatgtagttaccaatatcatgtcagataacttaaaggtaggaggaatggtaatgctgaataatagatgacttagaacagtttatatatttggcttcagctgtaggcaaagggagaatacaataaatatttactaattccttactccatgccaggcactgtggcactgaccatgaaatgaggctattacatagatgagggaagtccattgcctaatgacctgccaggaggctaatggctatgttagataattctaaagtttaccaacacttcatctgtctctcctgtgatttcagaacaaggaggactccactttaccagtcatgtgactgatcttggcaataaaatgtgggctgcaatgatgaatgccacttctgaactgaagtgcttaattgctgatgctcacttttccagccttctttgcccgtgctatgtagattgtagaagcatgtgtttctgcggaggagccataagagcacattagtctggaatgtttagttaccagatggagtgcagcttccctgcagccacggtggactttgcatgtatgaaaaataaacttttgttttgtcaagccagtgagactttggggttgcctgataccatagcatattatagactaaactgaccgagtggcagaatgcaaaaaaccctaggccaaagtgacttcaaagatcatctgttctccttttaggtttaaaatgttgtttcttgcttatgaatttttttgtttatcatatttttggtataaaagtaatttgtgaactgtttgaacactgaaaaatatagaatatactcaaatgaaaatcatcttatagtctaaacacagttaaaattttgttgtatttcatctcattttctatatatgtatatgtgtatgttttgaaattatagatatgttacagcaactaaaattttgtatcctactttgtatatgaaatatcattgctaagttttgttatattagacattcttgttgacctattttttaagcaacttggtgaaagtgtgcaaataattttttgcctttatctcatctgctagctctttttcttatgtagtacacagtccttattacttcttttcatacagagagaataggcattttatctgttccctgatccagcagcccagtcccctatgatggcaaatgttgcctaaattctatctcacacatcaatagttaagttgcttacagtgaatcaatcaaatattccatcaaaataacagttgagtgtttgagctgaccaactgtttgcctcactgacagtcctataaaatcagaatcttgtatttttttaccctaaaattgatcttacatcttacatctttatctttgtcctatactttctttgtttctatttttcttgcataccagggatctctgaaaaaattatagcagtaaaactcatgttaatagtgatccagttggatgagaaatgattggaagtcaaaacacctagaactatgaacttcccaaccatagaactgagaaatgttacagaaaaatgttataaatttcaaatagaaaaaatattgcaactttatttcatttgatgaaaaaacccaggagaaaatgaaaatttttaagacatttaaaaagtgtattgtcatagcctcgatattagaattcataaatgacaactctaattattgagacactttcataagtcataccccacacactatcaatatggtacagcattttcctttgttttgcttttctcattatctgtccctgacatagatatcatttttcagctttttctagtgacgctgcttagttactttttgcagaaatcataactggtgaaatcatctgaagcttagctaagtataatagtccactagtatcccactatcaaaaaataactcctattctacacttggagaaaacgtgcatgcatttgtgggcttctgaaagctatagcagaaactctgcaggcagaaattctttgtatacgtaacgacacatcaataggcagctacactgcaagtcctcccacatatccagcttaatagagacgcgatgaagaggctcactccaagtgtctaatcctgtcatgtattttatatagagcccatggtggtcaagtgctgcaggaaagttaaatattctcttagatgggcacgaagattttgcgaggataggaagtatctacaacaattcagcagaattttctgggataataaagatgccaaatagcagcagcagctaccatttatttagggactaacacgtgatagacacttgtaccaggcattttagaggttgttaaatctaacaagtatatgaaataggcatgtccagtttataaatgaggaactaaaatagagaggttaagtaactcgtacaatgcacacaattaaaatgtgaaggagacaatattcagatctttctgactttaaagcctgttctcttagccattgtgttatattgtctctatgtctgagttaacctcacagatcaccttgtctcttactagctgtgtgacactgagcatggatgttaacacgccttcattttctcctctgaataattaatgccctgccttcatgggggtggagggttattgtgaatatcagaaggagttaacaaatgtcaaagtgctctgtcaactgaaatgccatatgaatgggaactatgttatagtcaccattactggtaataccaattgttttcataattggaactatcctgcagttcctttcatgtaaagaatgattctagggcctgggattcaaagtgtggtccacagagctgcagttttagcatctcctgggaatttgtcagaaatgtggaatctcaggccctaccctacacctagtgagttagaacctgcagttttacaacatctccagatgattcttaagcacattatgtttgagaagtccttgtaaagggctgaaaagaaatctagattaaggataatgatctgtttagaagttttagagattttaggccttaatgcaggtagcagatggggatccttatgaattgttccttcaagaatctcaagattgctgggatgtctctagatgtggttaacagatcttatgaaatcacacaacaaatataagaaacaattggactagaacttgagtttctaacatattcaagttttttttccaatgatgtagtaaaatgtactacgaaatatttttaggagatgatattttagagaataaaatgtctaaaggtattactaaatttcctttttcagatttgattacttaaaaagtgaaaatttttatatcataaattacctcataaacaagagccacagacacacaacatatatgtaccaaaatatatagcaaggtatatgtgtaagcgttaaacatataaaaaaatccttaaccttggctgggcccagtagctcatgcctataacatcagcactttgggaggccaaggaaggagaattgcttgaagccaggagtttgagaccctctcgatgtcaagaaaatggaagttgaaagctaaaagaataccatttttaaatctatcagattggcacagcttagaaaggcttgattacttcaaatattaacaattttatgaggaacttgtcatcttcatactttttataggaataccaattggcgcaatatatctggaagtttctttggatctatgcacacttaaaatgattatatctcataactaagtaattacattttaggcaaatgttcttatatgacatatgtatatttttgtttaagtatacaaatatttttgtgtaatcatattcaaacttttcaataagaaatagacaatacaaaggtctataagtaggaggatggatacatacattatggtgtaatgatatattaaaatactctgctgcatttaaaaataatgagatagtttaaagaatgtttgttaaagttatccatgatatatacttcagtgaaaataaattacagtggaaatatatatgttttcacacgtgtgtgtgtgtatatttatatatatatatatatatatatatatatatatatatatatatataattttttttttcttttgagatggagtctcgctctgtcaccaggctggagtgcaatggtgccatcttggctcactgcaacctgtgagtcccaggttcaagagattcttgtgcctcagcctccctagtagctgggactacaggcttgcgccaccaatgacaagttaatttttgtatttttagtagagacggggtttcaccatgttggcgaggatggtctcgatctcctgaccttgtgatccacccgcctcagccttccaaagtgttgggattacaggcatgagccaccgcgccctgccaacacatgtatatttaaataagtatatatatcatcactttaaaatattgatatgactatatacttgtatttcaaacaatcttgaaaatacaaaagcaaaactgtagaagcagtaatatttggaggtgactctggagaagaatgaggactcagttttaccatcatatatattgtcttatttgaatttattatagcaagcaaatagaagatttgtaatttaaaatatagattaaaatggcactttttcctagattttcattatttttcttaagaagagcatcattttctgatgtttttgagcctctgcttttttctttgagcactgcctttcctagagctgaatgattaactctcctccttagggatatttgttgtgcagttcacaagttcaatgcattcaggtttttaaacatgtgctttatttcaattttaaaattatttttatcttgtttactcgaaatccaagaaaactttttgaataaaaaaataaaaagtctgctcattaaaatacatatgcaactttagagcatgggaaataaaaggactggaaagaagacaggaattagtgctggacaagttgtaaaaataatggtttccaaatataatgtttagattatgaggaagaaaaaaagtgataacaaatttgaaagttcattgtctttatcactctgggtattttctcttgatgaatagcaaagagagactcaagctatgaataggtcacatagaagaaatattagagattattttaaaatgtggttgcatctgtcttgtgttcagttttgtgattagattttagtgctctcaggcatcaactataccttgctgcttctataattttctatcctgatccctcaatttttagtagtttaggggcttcacagtcaattacaagggatgtctctggatttgaagcttttaacctagcttttagaagcagggtcagggatattattttgttccattgcaatcaaatgacattttcagttatagccatattctaagattgtcatttcttgctaagactttggaaaaggctatgattttgcatctagagagtcacctttctgagttatctgaaaaggaaaaccaatgagattttcacaatatctttgactaaaaagtttcaaatcatttttacagcattcattaaggtttacaaggctatatatgtaagtagagagaaaatttatctaaaatagagaataaaagtagcttagcaggacaaaggtaacaataaaaccctatggagatgaggcaaaaacagtggtttaaaaattgtatgctgtgtaggaagaaacacattacgtaaactaaaatgtggttgcaaagccttatctcacatctcagtgtgcttaagatgtcatgtgatttataatatactctaagtgtataacgcctaataataactgtgctatgccaggtaccaatctaacaactttacatccattaacagttatcattatatactcccaaccatcctatttgggatttgggggttggagttattatctcattttaagataaggatacctagccactgagatgttaaattttttgtgcatagtcgcacataaacaggaaaaaaatgaggatttgaacctagagatgttgacacttgtgtttataaatgtaatcatattttgtagatcacaatgaacaatgactgaggcaattagaattagtctttgaaacacaaagaaagcagaactatatgtatttaaggaatatggaaggcccctagcccaattaacatctcaccactggttttcttattaactaaagagtcactctgttttcattggaatacactatttttataactataaaatgtagaatttaaacaggtaatgaacagaagaggaaaactaaatagataattcataaacgaatatgttttcaacttcataagttattagggaaagcaagacagattaaaacaactatgaagtacctttttacattctttaattaaaaataaaatcagacaatatcaagagctggtgatgatgtggagacacaagaactgtcatactttacaggagggagtccaagctactatgaagagcaatttggaattatctaatatagtcaaagatgtggataccctttgatacagcaattttacttgtagttatacatgttagaaaaatctttacacatgtgcacaaagacacctttacaaaactttttatttttgtagcgttgcctgtaaggggaaaatacaaacaattggagagcatatagataaaacgaatgaacaagagctgcaagactcaaaaaatgaatacatttaaaaaatagtggatctaagaaaagcagattatccaaagatacagtatgataggattattataatacttgaaaattccaaaataatacttactgtttttagatatttatttgttgaaatagtataataacttataaagtaataataaacaccaaagtttatgcatagtgatgggtacctccaggaaagaggatttgaaaattgccaggctgggagcggtggctcacgcctgtaatcccagcactttgggatgccaaggcaggcagatcacaagaggtcaggagttcaagaccagcctgaccaacatggaaaaaccctgtctctactaaaaatacaaaattagctgggcgtggtggtacatgcctgtagtcccagctacttgggaggctgagccaggagaattgcctgaacccaggaggcagaggttgcggtgagccgagatcacaccattgtactccagtctgggcaataagtgggaaactccgtctcaaaaaaaaaaaaaaaaaaaaaaaatgcctcacagggagtttcaactttgtcttttatgttttattttatatacattttaaagtaaatatagcaaaatttagaaatttgataaaatggcagggtagctacttgacattcattatctcctatgctttgtttatgtgaataaaatattttacaataaacataatatgtgctctttatcagaaaatagaaaatgcaaaaaagaatacctcatttactccattacttaaagacaacaattttaaaattttaaaaattgttgtctttaagtaaatattttcttgcagtcatactattttacaactatttgtataccatatacacaattgtgtgttccaagtagagatatgtcatgaggtgtgtgtttttttctttccagtctctattaaaataatactctacccatgaaaacacatggaaatattattggctattataactccaggtgaattattttgagtgatagttttccaatcacagccacctattttgaggtcctgagggattgtaaaactagcaagcatatttccatagtaggaaatgggctaaagtttggtgtgctttctaaagggctccagagtccaaggggcaggtcagtaaggcctttgggtagtcgaggagaatgggcatctgcatgcattactgagagaggcggtctgtgaaggataaacttaacctgctttacaattttgccttgggctagccctggagagaatgatgaataatcacacaggatttaatgttgtactgtatctaatatgcagtttgaaggaatagtttatttttggaaacactgactgagacataatttatcatcagcatctaaaagggtgtgatcatttccaaccatttccaaccagcacagcatagcagcacataatttttttttttttttggtaaaatatgcctggtgtgactgattaaagagtgaacagtcctctgcagccatggatgcatttgtgatttgtgaaataggtgcctgattttcagcaccaggctctgtggacccagctctgttttcaagcaaagttaagaggcacatgcattggggtaacttttaaggggtcaatagaaaggctgagcttcacaacgttggtctgacaatatgtaattagagatttcttttatgacatactaatataaccctaggaaggataccgtgtaaactttaccagttgcctcattgctatgcagaaaaaggaagggttgaaatgtcaggttctggtttggggtaaggcgaacgatgttgtgtaacatctgatcgtttatttaaaatgtgtatattttattcatcacagattgttggattttgatttttaaaatattgcattgtattacaatattatttatcttgattactgaggttccttgtgtctccttatattttgtgtgagtgccttacttgccacactgtagtcccctaacgataaaatgacagcagaaaacatgtggaactccgcacaaaacccttcagctacctctggaggtgatgacatgggctcaaacatatcatttatatatatatatgtgtgtgtgtgtgtgtatgtgtgtatgtttatgtgtgtgtgtgtgtgtgtttgtgtgtgtgtatgtgtgtattatatatatatattatatatatatgatatggtttgactctgtgtccccacccaaatatcatcttgaattatactcccataatttccacatgttgcgggagggacctggtgggagacaatttgaatcatgggggtggtttcccccatacagttctcatggtagtgaataagtctcacaagatttgatggttttatcagaggtttctgcttttgcatcttcctcattttatcttgccaccaccacgtaagaagtgcctttcacctcccactgtgattctgaggcctccccagtcatgtggaactgtaagtccaattaaacctctttttttcccccagtcttgagtatgtctttatcagcaatgtgaaaaggaactaatacagtaaattggtactagaagtgggagtgttgctgaaaagatacctgaaaatgtggaaatgacttcggaactaggtaagaggcagaggttgcaacagtttggatggctcagaagaagataggaaaatgtggaaagtttggaacttcctagatatttgaatggctttgaccaaaagtctgatagtgatatggacaaaaaggtccaggctgaggtggtcttagatggagatgaggaacttgttgggaactggagcaaaagtgactcttgttatgttttagcaaagagactggcagcattttgcccctaccctagagatttgtggaactttgaacttgagagagatgattcagagtatctggtggcagaaatttctaagcagcaaagcattcaagaggtgagttgggtgttgttaaaggcattcagttttttttttaatttttaatttttaattaatttatttttttattattatactttaagttttagggtacatgtgcacaatgtgcaggttagttacatatgtatacatgtgctatgctggtgcgctgcacccactaactcgtcatctagcattaggtatatctcccaatgctatacctcccccctccccccaccccacagcagtccccagagtgtgatgttccccttctgtgtccatgtgttctcattgttcaattcccacctatgagtgagaatatgcggtgtttggttttttgttcttgcgatagtttactgagaatgatgatttccaatttcatccatgtccctacaaaggacatgaactcatcatttcttatggctgcatagtattccatggtgtatatgttccacattttcttaatccagtctatcattgttggacatttgggttgcattcagttttataagggatgtagagcataaaagttcagaaaattattggcctgacagtgtgatagaaaagaaaaacccattttctgaggagaaattgaagccagctgcaggaatttgcataagtgacaaggagccaaatattaatccccaagacaatggggaaaatgtctccagggcatgccagaagtcttcactacagcccctccattacaggcccggaggccaaggagaaactggtttcgtgggccaggtccagagtccccatgctgtgggcatcctagggacttggtgccctgcatcccaattgctccagctgtggctgaaaggggctaacatagagcttgggccatggcttcagagggtggaagccccaaggcttggagaggtgttgagcctgcgaatgcacagaaatcaagaatttgggtttgggaaccttcgcctagatttcagatgtatggaaatgcctggatgcccaggcagaagtttgctgcaggagtgcggcactaatggaggacctctgttagggcagtgcagaagggaaatgtggggtcggagcccccacacagagtccctactggggcaccaccttatggacctgtgagaagagggccactgtcctccagaccccagaatagtagatccagctacagcttgcaccgtttggctggaaaagccgcagacactcaatgacaacctgtgaaagcagctgggagggaggctgtaccctggaaagccacaggggtggagctgcccaagaccatgggaacccaccccttgcatcagtgtgacctggatgtgagacctgaaatcaaaggagatcatttggggcttatttctgcacagtacctatcagcttttaatgtattaacttatattttctgtctcttttccactaggatgtacactccatgatgtaggtatttttgtctcttattcactgaattatttcaaaattgattagttgtaggcataagtgctcaacaaacttttgctgaattaatgaatacgttgataatggaatgtaacttctgtttttttcatgtaaaagtgatatttttgattaagcaaactaatatttgatgctgagaaaaaaaacctacaaagaaaactaaattgttcaaaaacatagttgttcaggtagctaactaaatacctgcagtggtgagttggaagactctcagtgatatgcattgaattaattagataatctgtctctcttttcccttctcactctctcccactctttgcataaaatcaacatttacaagagaatccctctttctgagcacttttctgtcactaactcagtctcactcttcattaccttttttacctgaacaatcgttgggtcaccaattataatatctgtctattgattaactcacatctttgcccctttttcttttggctcatttgtttaagttacctatcaaactgcaataattatactttttttgaggatattaatactcgctaaccacaaacaaaaatcattctgacttctgctatgttttgcactatagtacttgaagaagagatggcatgggctcagggttaattcattcattaattgagtcattccatttattcaacaaacatttagtgaacacctatgtgcaagaatagtgttgggtgttgtggacaaattaatgagcaaaaattggtcttctgtgtgttcttgtgtagatggatttaaaattatcactatagtgaaaatgcagtagtatatacagttgttcattggcatctatgggagattagctcccaaatccccacaaatccccaaatccctggatgttcaagtccctgatataaaatggcacactatttgcatacaacctatgtacgtcctcccatatacattaaataatctccagattataatacctaatacaatgtaaatgctaggttaatcgttattataatgtattgtgtagagaaaaatgacaagaacaaagtctatacaggtcaggcgcggtggctcacgcctgtaatcccagcactttgggaggccgaggcaggtgaatcacgaggtcaggagattgagaccatcctggctaacatggtgaaaccccgtctctactaaaaatataaaaaattagccaggtgtggtggcaggcacctgtagtcccagctactcaggaggctgaagcaggacaatggcgtgaacccgggaggcggagcttgtagagagccgagatcgcaccactgcactccagcctgggcgacagagcgagactctgtcttaaaaaaaaaaaaaaaaaaaaaaaaaaaagtttatacatattcagcacagaagaaaccacccagttttctcctgaatattttcaattcttgttgatgtgaaacccacagatatggaagctgattgcattttaactatcaaccaactatcaactatcctacatattttttttccgtttaagaaattttcttttattctgtggctcttctttccgtattgtgggatgtctacaaccccatgaatgttcgttatagcaggaaataagagctccttagagataacacctggttaaaggtttgaagttctaaaagccagccttaatgctatgcttgttacaggtttcctttgttcggaataataactttttttggtattaagtaattctgaccaaaaaaagtatataaagtagatttgattattattccttttacaaataataaaactgaggtacaaacaggtagctcactttctaaaggccccagagttgtgaaatggtaaaaccgagttgccaccccaatgatctaaacacctcttgtctggcttttgcaggtgaaaaatgacttccaatcattgtccactcaataattataatctctggtaaaaggccatttaaaaatagatttatggccttattttctaatcacttttgggatatgggaacaatcattttaaattgaacagtacctaaaattcataagcacatttattagattacagtagcacatatggtattattttcctgaaaattgaaccactggtttgaattgcacgaaatgtccaagttaggttattcattctcatgtactgagtgtatcatttttttcttaagaaattatatcgattcctattgaacaccagattggttttaatatttaacaagttaaagcattcctgggaacatggaagcaaaaattcacttgtatttagtctttgtgcataaatctagcctcttctgtagtaggataattgtttattcaagatatagctaaaaccaaccttaaaaagacagctattatactagctgcttgaatttggggccctctgctgaattcattgaagtagtttaaatctaaacttaatttttatcttttcaatgcagacatttcctgctttaatgcatctttgtctttttggccatgggacgttgaagaatgaatgacaggatatgtgcagctatttgatagaatacatttttaaaaggaggtgtgtgcacctgccaaatacacagcctatgtactggttgatgaaagaattctcagcaatgcatcttctcttggggtccactcccagatttcagtaatagacttctttgggaactacataaacatacttgtgtgaatgatgccaggactgctgttccattgccaagaagggcacatactagtttacagtctaggtatcctgggggctaaaagcctcacaggcctcagagaatatcattataaatgattttattcatttcattaaaaaatctgtataagagagactcattactaaatgtacagttaccttaatgaattggcacaaaacatgttacttgaattaccaattttatatcaatattttccccatcccttatagaaaaactgctgaaaatacggaacaagcatttaaaaaagttcttaatagaagatacaaataaataacatgtttctatagtgtacactttgtactgctgggtgaggtgacagaccatctgtgaagatacataaataatagctatctaaggatctgactgaccacatctaatcaagaaacattgttgataactgagaaccagcagttagggcatgccagacccaaggggaagcaaatgtttttctcccatcagtaggaagctgctgtcatgaggtaataaacaaattaagatctcccacaacaaaatacaagtggtatatcttggggataatgtcttagtaattgcattaatggaaggtcattttcaacacatgattatttcttgtgggaagtaatctttttgaagaagtacctgaagtatgttttatgttaactttgaaagaagataaaaggcactcatgattttttttatgccagcaaacactggggataatgagtcaccgaaagtgaatatttttcatgctatcttgttaaatagaaaatgaacaattatttaaagaatgtttcattagaaaatgattttaaagtggaattatataaagacctatgcaggacctgtttctacaaaccaataagaagggactcagatgatctctgtatataggtggagagctggtagttgtaagatattgatattattcaaggatttctccatttactgtaatttctagatcgattttcaggaagagtttgcagtttgtttatgtgaatattatatttatctcttttatattttttctgttcaagtttttcttgtttgttaaacccaatatattttggtttgtgggaatttccagaagatgttgataggatagggataggtttaggggagagattcccttaaaacctataccctcttgctctacctacatgcagattccagccctctagggaagagaaagaaagtgtgcttttctcagcataagtcccttccacccacgtaaaagggtacatgagaaactagtcaggagagaacattatttgagatccctctgaagattcatatgcacatcccctttcagtcagaacacaaaaatctctcatttgcaaaatgacatttataaaatatttctgtggttatttgattaatttctgtcatcttcactggaccatatgctctaagaacaaaaaggcaatatcttttcttgtccactacatttccatgtatccagctcagccagggaggaatgactgattttgtaactcaggaaaccccaggagttttcagccctctgtttctccatcaaggctcacctggaattcctaagattgcttgagtatggtgccctttgtcccttagacagaaggaatctgggataatatctggcattatccctctgctaaaatcatatagggaaagctaagtcctctgttggtgaaagcgcaatggtttaggattaggaattagaacccaaatccttctcaacccaatcagaggaaggaaagcagcagaggcttcaaaatctatgtcaccttttattctctctggtccccttgtttctcccagttaatccaaggaagttgtggcaaggctgtacctgaataataatagcatattaatctatacaaacattttaacatttgtgattgatttttatatatcacaataaagattatgctactaaattaataatatgaattgtttgtattattcattttagcttcgaccttatggtacctccaaacttcatagtttactgttcagaaatagtatgaattcatgtattaattcatttagaaaatgtttagtgagtgctgttctgtgccaggcactgtgcttgctcatggaaatagatactaagggaaaaagacatactgtctctgtcttcaaggagcttacagttaaggagatctactgtaacacaagaaatattgttttgtgtctcacacctgggggattatttaatagttggaaagaaatttagatggggagaaacaattgttttaacaggtaaaaaagcctattagcctataaatagttttctagcagagagaaaaaaccttgcaagtctaaaaacaaaaaaaattaagagcaatacatataatactacataatattattttttcttctaatcttccaaagttacaaaaattattagctcttatttcaatcatttcgtttaggttgactttttatgccttcttaaaaagttctttcatctattttcttttaattccaaaagtgttcagaaagaaaatccaagctaaaatgaaagatgaatactctttgcaatattctgacattttgtcacacccaaaagaaacaaatctaatctacacattctttatttaattatttattgccttggtcaatatgtaactatctaattgcatacatttttatatttcagtacagtttgtgctttgaattttactaagaggttttgagaaaaaaataaccgtttagctattatgtgaagaatgtcatgcataaatgggagtaaatattacttaacaattgtataacaaaataatattttgcacatggtacttaaggcaaatctttctgtaaggcaaaaggatttttttaaaaaaatttaatctggcactttagaaaaatatgtgagatttgaaaaatttcaagtgatatatgcatttctactttggaatccattttaactttcaagacaaagcaaacagctgttagagtctgagaagctaggggagagaagcagacatgaaagactattccagaaggaatcctgaactagtttataagatgctagtcacatcagaaaaagaccaattgttttttctacaaatgtcaaaggaagattttaaagtgtggggttgattttgttttccagtttggaaaaatgtgttactcctaggtgttgactctcagacaatgtttctgaagcatcagaaaatgtgtaaagtaaactcctaaatggtgatcttgaggtatctgcaggcaaactctcaaatgtagtgattgaaatgaagtctttctcatcagcctggaaaataaccactgttttctccactttacttcttaattgctaaagggcaatatcttaactctaatttatcccagcacagagtttgttttttagttgctttaaaacggagactatattgataaaatatttttatagctttgctacagcttaaaatacttttcttaccatgagtattgccttggaaaaaattattacaaaagttgttggatttagatcttgacccctaacatccctctaaaaattgtaatatttgttgaaaaagaacactttattgtgtaattgaggaactactaaagcacacctgagttttatatgcttaaatcgtactggtaattctatagttcctcatgttatttgtttagcaatatctcctttgcactatactaaaagctagttaaatagccaccatgttgatattgttcaccagtgacacctttgttttgagttggtggcagagtttctacatgtatcagtgagacccttgaacaggttgttcaatgcttcatttatgatttcccattagtatggcctagtcagtccaagaaacaagggcttttgccgaggacctcacttcagaaataaaatggaacaacaatatattttgatttgctgaatgaataaaaagacaaattgttggtcctctgccttattgttatgttgaagttaattgaccatatttaagcagacaaaataattctactaaatagaaagattagccattacttctacagtgaaatcctctgaaatactgcatgtattgatttggatctttgacttttttcccctgtgttaagcatttttgcatctttcactctctgagttaaatgaaataaatgaaacttaaataaaatatgatatgcccaggacaaggtttgtgcacatttctagtaaaaatgacgaatgggtttagtgagttatttttagtcaattatgttaatggctgactataagtagggtcataaaactgtacatatcaaatatgtgtagttctttttatatcaattatacctcaataaatctgttaaaactaaaaaagcagagtgtctattttaaaagaaatttgtgctacaatctttcatgaaaacaaagcagaatagaaagaatgcttcaaattgtcatggctgatacagtaattgcagtatagtatagtaattgcagtgttaatctatgattttaatttataattaatctataattttaataagattttatttgaataagtttaatgtattaagtaacaatagttttcaatgaaaccttaaactgttctttcttaaaattatgtatactaaaaatgtacaagtcttcatatttactttgatatgatttccaattgtgcaggtggtttagaatttggaaaatgtatacttcagagcttgactattacataattacaaagacgaagcatagattatgtcctcaattatgaataatacttcatacttttcatgattagtttttgattttactgagccattctctggggctttcacaagtattggcaagggacttgaactctggcaatttaacaggtcgtttaatgctttaaagatgattcccattaatatggctccatcagaccaaaaatcatggacttccataaggctttttcaggacctcaattacgttaggtatttgagtgcttatccaatatactgatttgattacttgagatgtatggattttagaagaataaaagcaatgtttatataaggcatttatgcccaattctgaaagtaggaaaagatagtgcctgacaaataaaccatcataatgaatggaatttctatcaactaagatctttcctcctccattcctacaggttcagccaaattgggtcctaaaatacctgcattaattgagtgcattatttttgttatcatgggagctaatgctgaatatttcatagcatcttaatgttggaaggcaaatgtagtggtcatttatttcaattgcttctttaatcagaaaaactttgccctttaaatactcaagttgcttcaatgctaaatggtacaaatttgatcaggtgataaatatagatcataatgtttaataatgataacacagcaattatcaacctaaaacacctttgctgatatgactactacttatgttcgcttaacgagtattcccatagcttgcaattttgactcaacattttaaagaagatgcttccagcctgctaggttaggttcaagtgatttgcacaaggcttccactaacaggaagaaatgtctatgtccctcgcagcagtcacacatttaatcaaatacagctcataaattacatttacaatctttagacttcaatcaatagggtattttatagtctgtagaaaaattatctggagagaagtaggagaaatacaagaaggatgtagctggggcctgtccaggtctagaatctgcactcttgtcatgctgaagggattaacctaccgattttaacaaagagggatatctccaaatcagctgtgtgcagggccagggcaaagttggtgctaatgaagcattctgggaagacatgatcaatagcaccaaagcaaagaaaatgtttatgttctttcattcaacttcggagtgaattacaaaaattaattggggaaaagatcatggtgcttacagtaactgatcccagtttacctgcttctctgtaaaagtagcttgctaatgataatgtatcttaagatctcatagttgtacaatattatactttagtggcatatttcctggacacaataatgtgctattcctttttcactctcactgtgataaaaattttgctaaagttgtagaatcacagtttataaaataacagcttcatttagattttccaccacgtgcacacaaataggttatttaatcagtttctaaaattatatgagcagtagaagatgtcctgctggctggtccaaaatactttgatagaagaagtgagaaagatttcatttagatgctctaaatctttctgtactttctattaatggttatgcaagttttgtggcaaatcatgctcccaaataagagaatcataccgcaaggaatgattaccatatatttatttagtttctggtatataaaatggtacctatgatatgaaattaaattatacatcaatgtggaaaatgatggactttttgagtctcgagctatcttaatgtcagacaataaggattgtgattgtgatgatggattattgatgtttaagttcctgagagtaaaatgataagaacttttcacaacacaaatatgacaatgccaatattcagaatagtgccatcacttggctttttttctttcaaatttagcacatgggtttatttatggcagacaggtatatattctgtgtctcctgaagtcccaaagttctcagactattcattcaaattcagggcaggttacaagaaaggatttagaatctggctgactctgactttctgacttacaggtaatgcacaaagtccaaagggcatacgtacatacagacacacacacccatatatatgcacatatatctgcctagatgtatgcatatgatatattaaaaattatattaatgaaaagataagcagtagcctgggataaaatatttgcaaattttacattaataatttgtatcctaaatttattaaaccacacaatataaatccaataaaaataaggaaaacatttgactagacattacaacaaaggagatatatgagcggcattatgtacattaaaagatatttaacatcatttgtcattagaaaaaaacacaaaatgataagatattactttctattcattactactactataattcaaaaaccagacaataggccaggcgcagtggctcacgcctgtaatcgcagcactttgggaggccgaggcaggcggatcacgaggtgaggagatcgagaccatcctggctaacactgtgaaaccccgtctctactaaaaatacaaaagattagccgagcgtggtgcggaggcctgtagtcccagctactcgggacgctgaggcaggagaatggcgtgaacccgggagggggagcttgcagtgagccaagatcacgccactgcactccagcctgggcgacagagcgaaactccatttcaataaataaataaataaataaataaagccagataataacaaatgggtgagaatgtagagaagtgggaaaacttgttacatttcttattgaatgcacaatggtgcagtcgttttggaaaacagctgggcaaattcttagaaagttaaacgtaagtttacaatacaaaccagagcttctactcctaggtatctaagcaagagaaataaaaacatgtccacataaagacctgtatatatttttcataatggctaaaaattagaaataattcaaaggtccaccaacttgtaaatcgataaaaagtagtatatccataccatagaatactactcagcaataaaaagcagtaaaaaacattatgctaagtaaaaataaaacaagccagatatgaaataccacatattgtacaattccattttatgaaatatccagggaaggaaaacttatggtcataaaagtggattaaggattacttggggtaagggatgacaatggggagtgaatgcaaatggacacaaagggatttttttgggggtgatggaaatgttctaaaattagattgtggtgatatttgcacaaggcagtaaatttacttaaaatgagtaaaatttatgctatgtcagttttacttcaatactgctgttaaaaaagcaaattatactcttagacactagcattagagtctcaaggtaaaaatcaggttagaacatgattcagagaatataagaaaatttaacatttctagaattccagaaagaaatttttcaaaaagtttgcaaagttttatctaaaatttattttgatgttgtgtatcaattattaccctccttagatttgtgagctccataacagtaaaggtcttgaccttgttcatcagttttttcctggcacctagaacagtttctactatagaggtgttactcagtaaatattgataaatgaacgaatgacatgatcctcatctagttggtcaacttatagagaagtttcccaatgattcagtgggggtttagaatcgggcatgcagatactgataagaaaaaaacaggaggtagcagaaggcctgatgcgtgatcagagatatacaaggacagggaaggctgagattgagaggggcattatcaatcaattccaacaggaaatcaatgacatactcaaacaatttgaggaggagttttttttttttttttacaaaaaggattattgacaaaactatactcaagatataaagaaatcatgaagatatagcaagctggggctagtaaatgggagaagcttcagcagagggtcctaagacaggaaaggagggaggacttcctgaagcccagatggagagagttgaatggagaccttttgttaaggtgttagcccatgattacttctcatggcaaaagccagtaagagaaatacatcgatctcattctcctccctctttctcatgtcctgcttggctctttattgttcaactcaaacagaagtccgggcccatgggagtctgctaaatatatggatagctcagccttctcctacagaaacatggtagagaaaggtggaaagtggagatgggggtgcaaatggaaggtaacctgcacaggagtaagccttagaccactggagtctggggctaagtgtaaggaagaaggaattgaagtataatgcagaagctgaagattaacactgggtatttaaaccccttgcttggataaatagggaaacgaatatagaccgatgaggtttcaatactatacaccttatatttgggttgtctttgaagtatggccaggctgagattttaggtaggcaattagtgggctgcaatgcgaacagctgggagagacagatgaaagaaaacaggtgctgatcttacctgcattaaacttcactaggtttgcttttccgcattgtcccactctcaaaaaagaaaaatcatttgctgcctttttatatagttacaataaatagccactaacagaaaataaaaaaatcttgattaaggaagctttggctagtcagaaagcaggggttcaaaacacaatgtatcccctaagcaacttgcttttctttagataaatgtatttgttatggctgcggtaacaaattaccacaacgtgggtggtttaaaataacagaaatgtattgtctcatagttactgaggctagaagtctaaaatcaaggcatcagcaaggccataccccttctgaaggctctagggaagaattctttgttgcttcctcctagcccccagtggttgctggcaatctcttatctcttacacttcttggctgcatcgctgccttgtagttcctaccctgtcatctctctgtgtgtttctgtctgtatccaaatctctccttatagcagcaccagtaattgaatttaagaggcatcctaatctagtatgacattatctacactttcttacatctgcaaagaccttgtttataaacaaggtcacatttgcaggtagcaggaattagtacttaaacacatctttttaaattatacagttcaacccataagaataaatgataatacaaataataaagatctcatttttatgtagcatttcacatagtactttcatacacattttgccctttttccaatcccaactttttctcatctttttaaatcactctgctgagaggcaggcaggataggtatgacatactgaaacaatggtgagtataaaggcattgtgcttactttctgcagctcggattgtgatttgacccccttatgcctttacccctgaacctaccgcttcttctgcttactatattgcttatccgtaaatttattcctttacaggtttagaatggcagggataacctgcccactactttatgatacaaagcacatttcttttttaattgtgtatttaacattaaacattttatggtactgttagtttagttattgacttggtttaaaatcatccaaataatgataattacggtatccatctatactcttgactgtttctctgaatttatacatctatatacggaaagtaagtggaatttaaagacagtataatcttatagggatctgtgggcccttaaaacatttttagtttagaataatgcctggagtagtcaacatataatgtcataatgatcttgaattcaggctccttaggctgcattttgcattctaaaaatgaatgagttggttgaatgagtgtataaatacatttcaattatagccatatctatgctttacataaaaaatcaaacctagcttttactgactgatctagaatgtacttactcttaaagtaccattgagaaatacttaggtatagcaagattttgaagcaaaagaaaacctttgaagatataatattgattaatgattattgatataacagtcttccactgcacgtaacaaaatacccagctcaaactggcctaagtgataacagaaattattgtcttagagtaactaacaatctccatagattaaaaaaaagttttagatgggttttattggggagttgggtttatttctctgccatttccttctccgtgtgttggctttttatcagggttctatacccttattaagcaaggctactgaaccacatctgacctgcacagccgggctatcacctttccagcgttcacatcaaggagtctgagagtcacactgctcgtaggtgaggtggtcatggactcaccctgagcctttcttcaggcaggaggactgaaatgtgctgatggctccaaagaaaccaggacctacccctgggtcaaaggggaaggatatatacttgaatgaaaattagaataagttttaagaagagggatggcagaataatcaatagatgtctacaacatacacccatcaaccttttcaatattctttcctgatctatgtagagagttgatatcaccccagaaaaatatgcatgcacaattaaagtattgtaccttactttctttgtcatcttttttttttaattctggtaagaacacttaacttgagatctcttctattaaattattaaatgcaaaatacagtatacataattatactcagaatgttatacagcagatctctaaaacttatatgtcttatataactgaaactttatacacattgaccagaaaccccaattttcctgtgcccctagcccctggaaaccaccattctattttttatgagtttgacaattttagttaccacgcgtgagcgaaatcaacactgtaagtgggaatataaactggtgcaggtgctatggaaaacatggtggttcctggaaaaaaataaaaacataactatcttatgacccatcagtctcacttctgggtatatcttaaaaggaaatacaatcaagatctcaggcagcaatgctcactcacctactgcttacctcctactgtgtggctcatttcctaacaggtcatggaccagtactggcccaggggtgggaacccctggaataaagaatcataactgagatgttgttcaaggctaatctagaatcatatctgtgcttttagtttcagatcaatggtgacattagattctcataggagcaggaaccctattgtgaactgtatatgcaagggatcaaggttgcaagctccttataagaatctaatgcctgatgatctgagcttgtttcgtctcgaaaccatcctcctccccttcttcctgctggccaaggaaaaattgccttccgcgaaaccggtccctgttgtcaaaaagtttgggatcgctgctttattcaagagaccaacgctgaatatctggtatgtcccaggtactagctatggtgagcagcagggactgagagtagaggaacactacacggataaattccacatagttcctaccatgacagaaactcatagtcttgagtattcttctgaccagcaatggaattttaatatagcagctaactcataaagatacagtgaaaattaaatgacttcatatctgtaaagttcttgtcataatgcctacaactatgtttaatatttaaactgtgatagtgaccaggggataggtttaggccaaaaaactaaagttatgaaagctatctatcatataaatacaaactttgtgggaaaaaattcagtattattggcattcatttagagggtattaacaaatcacttgccctatcgtagtgacctaggtggtccagaagctggtaggaatcagtccttggagtttaggagtttattgtcctttcagagtttcatgtgaaaacttgaaacagcatcttaacctgtttgattccctccctctatccgcttcccatttatcccccaagttagctgtagtttagaactttaaatggtaaggatggatttttgtaaaggccactcatacttattttttagtggtactaccaacaatctatttactcatccttttaagcttttcagtgtgataccttaatgggaacttttacttaaaaagcagggttcgattaatcatttcactttgttgctatatgcttacttttacatatatgtattaaaatagaacatatctaatgagtggtaaaatctttatgtagaatgtttttgtctcagtgtatcttaatataaactacaatagaatttaaaaaacaaatctggaagaagtatctgcactccaatgttaattgcaaaattatgctcaacagcagatgggaacaacctgagtgttcatcaatggatgaatggatgaagaaaatgtggtttatatatatgatgaagcattattttaccttaataaggaaggaaatcttgccatatgtgacaacatgggtgaacctggaggactatatgctaagtgagataagccagtcacaggacaaatattgcatgattccacttacatggggcatctaaaatagtcaaatctatctatttttatttatccttatcaataagttcatatgtctttaaataaaatatctggccaataagagcaaagtctcatttttcaactgaaagtgaaaaaaatctaaggatcatagtttttaatttcttaaagatgtaggtgaatttcttgtatatttttgcttaatttctaggcatatgctagaagtgaaatgtaatttagaggactatatttctttccaattgctcatttgcttgttgaataaatatttttgttaaatatcacaatcgtattactttggggaatgttacttataatagtaatacttaaattgcaagatgtaatgttataatctttttatcatcaccaaagatctttattaacattttaaatctaaagctctaaaattaacaatttaaagttacatagatagaaaatcattttattcatatgttaaggttaaccctatactaaaatattataatcatttttataatgagggcatttactctgtgaaacaattagggtaatgtatacaacataaatgtaaagatattgaagataatgagatatgtctcataggacatatgttttacaaatcttagtcaattatttagtgtaaaagactttcatcctaaattaaaatgaagataatacctcactaaaatgcatgtaataatttattctattatctcaattcatgtcttgatcatatttgtttagatggataaaaccacttaagaaaaaatggtaaaatatctggtggatatacaaatcacataatcatgagttaataagaactcatgttggatttcaagagttttttttctaaaactagtagactaaagaaggtaatctttgcaaggttgttagaaatacccatcacaaaaatactgcatataagttactgagggctttttgatgttttacactgaatctttaaggtttctttccttgccatatgtaaagaaacaaatttagagcatattttgcatttatgttttcttgttataaatttattcctgaataagtatcttctctttaggctttaataatatctgattccttgggtatgtatactggcataaatgtaactcactcaatatttctatgcctctatttgatattattaatttacattgatttattcaataaataaatagttatttaatatctcctgtcctaacctaggttctccagaaagcaaagcctcagacaaaagctagtgtgcttctatccctttcaggaagtttaatcccagggagcagaagtgagggaagatagtagtaaagaaggaaaggagagaaaaccaacgcagggatgcataatctggctaccgctgagtgtcaaggataaattattgcttcattttgcccaactgcttcgtgagagcgtacgtaaattattacttctccagatagtctgataaggggaggtaattcattcactggcttctgtctctttgtggtgagactgttagtttccctacatttctgaattgcacatgccagggcataaagaacactggggcatctcaccagatcagcttcagtggggaagcccagggaatagtaggtaagaccagcacaggatgggcatgaggtaaggcattgtccggtcatgccctgtgaagtttgtcacgcaatctcggtcaccccaacggcaactgtggctagaataagagccaatatccctagagaccttatctccagatgacctaaaactaagaggacctaaaatggggtatatatcaggaacaaaacagacagatattcttgcttttttggaggttgcattctggcagagggataagacaataaagaaaaacataatgaataacttatatcccatagtagaagataagtgctatgggaacaattgagcaggtaagagaggataaggaatgtttgggtggtgggattcaattttaaacatgatggtaagggttggcctcactgagaaggtgacattagagtaaaggcagatggcacacagtcccttgttgctggcaaatcagtaggaagcaagtgtggcagggtccatatggtccagtggggatgggaggaatggaatcagaaagggaagaccaggtaagtcaggggcttagaggactgtgcaaatatttcattttttactctgaatcaaaggagaaccccagcagggcttagagccaaaaagcattatacaaattatatatattggattttggcttctctctggagaagacacaagaagaagtaacaggtgggagcagaaaggccagaaaaaaggcaattcgagtattccaactaatttcgaatagttttatgattctttaagataaaaaaaatttgattgtaaactttttgatatcaagacaccatttgcatagcagaataaattttaacatatcacgattgtgtgtgtgtgtgtgtgtgtgtgtgtttgtgtatgtaccaaatacgcgtgaagtttcttttgaaatttggaatctgattcagtcatttttattttggagaaacatgaaaaaaatcctttttcattcaaatttttgaaatgtggattttaccatggaaaaaaaacttctaaattctctagctgaggatgtcggtgcctttaaatatgatgctaatttttcttaaggaaatatctctcaaagtcaatttgtttctgataactaatttgttgttcagtttttgaagtgctttcaaattgtttgaggttctctgttatgtcttcatatataaagaaatttaaactttaaggaccgttattgaaaaagattaaataaatgaccttaggcttttagtctagtttccatttgactttatgacaaagttgagtttaaaataaaatttctcaaaatctgatattaaaagatgtaatattattttgaaaattctccctcctttattatttgttgttgttgctatcaatgatattttaattgaaaacataagttatgaagaatggattttacaaataatttactataaattattcataatttacatcatttggtaattttatccctggaagtaaagcaaaactttatattttgttcataattatcaaagttactctataacaactataattaatacatatatgacagttaatagaaattattgacttcctgaaaacatccatttttttctcctttttctccttattttctttctgtgttttttattttctattcattttcagaaagcaagttaatttcttttaaatgagacaatttcacacactgtatatatatatatattttattaggtgattttcaccatatcttgtactatttgatttcctttcttcagtcttcctctgtaaactattgtaaagctaatcagtgttaatagattatattttaaattattcttctaattagttctccctttttgaaatgtcattaatcccttgaattaattaatttcatatgaatatgcatgacatatttttctaggaagtccgtttaatttagtttggtgattgcattgctaatcacctagataatttttggttatcctcatcaaataatgtttactgaggcttatgtttatgaaatactgctatgagaggtgctgtaagagccctgtgtggcttcatctaccatgattcacacttgttatgtctatttaattttccatactttgttttttttctctcgggcataacttgatttctctgatactttagatgcaattaaagagtctttagtggtcagaagttccacttcataatttcagtgattgtctatgttttatctgtccagaaggttttccccttttgggggcgacattaaactctcacatctttaggggactactcagttctccttttagcatattccatttactccaacccttggtccaatatggctgttatttggctggttaattgaagtagcagaatcattggccaatggcagtaagcatgtgactcaaacctagccaatcagtattcttccctaggtttgtttttttcttccttggaataaaaaccagtgctatgaaagaagcgatacaggttattagttttccatctgttaaatttttctgagttattctggtgtgaatgtggatgtatgttttactagaaagcccatctaatttagttttccagttgcattgctatctacctagataaaagaagtgaactggaaaataaaaacaaaattagggatcttcaataaaaaggcattttgatgatatttgcagctctggagctaatcatctttgaatttaactgtaccaggccctttccttggtttagttatatgaagacaacagagtccttgtattatctaaattgctctgactctgtaattttctacatgagtggaattagtttgggttgcttaaatacatggtgatcaatcattacatagcaaatcacatcaatgagtttacatatatcatggctaaagcctacatgcttaactctacagatggaaaagcgggggatgatagactttagcactgtgcctgagcatcatctccttactcttagtaggaatcagagagatgtgacctttggcccataatacactatgaattcactttcctcctctgaaggaggaaattgacatgacaaacaaaggattttttagcattgccaggaggatatttaaaaagcactttaaacgcagtgaaataaaagcaccaataataaaaaagtcatataaataatatataatcccttactcctgacactggtagttatttgctcatattcttacaataatattaaatcactattaccaggagacctaaatttataaaccaagtttggcctccaagcaagtccacaattgcctctgtaggcaagaatgttggcttttttttcttacttttctgcttgccttgtaatttgaaattgtactcatagtgtggcaataaacttgtaatagtcagcttttagaattactagacatctccttggcatgaaaaagcaatccaaagcctccggaacactatattgattcattttaaaaccaacccaataatttttctagtgcaagaatggaatgcatattattttatttaaaaactaaagaatgtatgtccaaatagtttcagataatacttgagagctagttcctttgggtacagtttctactttttcaattgttttggagtagcaaatataagaatagaagataaagtacttgcaggcttcttcaataagacatcccttattgctataaaactaccttgggctaattccacactaaaactgacagagcatgagactcaagaaattaagtttttaaaaaagacctaaaatgccaattttaaatcacagtataaaccaccaaagtaactttcagagtttttgaaataagtaaaatatcaactgtgtgatgaaacttaagatataaaaccgtgagcttattacttctcatgaaattccagattgatattcacacggcttcaatattacatgtaatcaagcacagtaagaggcctggcacttagtaggtattccaaaaatgttgaattaatgactaatcaaatgaaagaaaagacacatttcagagtttataaaatatccttggtgccaagtgaattgttataaaatcttaaattctattctttcagggtgctaattgttattagtgacccatttcttattcctatacacttcatttacactttggcttgtgtttcagacagaaattggtactgaacttaggagctgattcttaaggcattaagaacagatgaaaataaagtctatatgagagctaggatttttgtctactttgcacattacagacagtgaattaagcatattcaaagagggagctcaaggtataattgataaatatatgaatgaagtggaaagtggagagaggaaaatcattttccaaattgtatacagataacacattaggaagacgttatcagatctgaggtttgagataaaacaaaatgaatgaataaaagtattggataaagtactggggagaaatgaaatgggtttggatagatctaaagcagttcaaggtttttctattaataacacttttgatatattaaaatactgagaatactatcagttggaaaacataactggattaatatttttccttgtcaacaacaaactggcacatttaaattcccactccctttccccaaaagacaagatatcccagagtttaaaataaagttttatactttgcaggcaacttgtcaagaatgcttgtgtttcatacatgtgtaatcctccattgtattaaacacctaaagccaaagttattactttattcacaaatggtcatagttctaacacctactaccgaccaaaaataggtcaataaattaggtttaaacctcattttctttttttgacttttatttaggcttgtggatgtgcaggtttgttacatgggtaaactgcatatcactgaggtttggggtatgaatgatctcaacacctcagtagtgagcatactacccaataggaagtttttcaacccataccccctcccattctcttccctttggtaggccccagggtctgttgttgccatctttatgtctatgtttacccagtgtttagctctggcttatcaatgagaacatgcacaaacctcatcttaataagtgaactctacaagtatttactgcaaatgtaacattgagttgggtattacaggtatcagaaaagattccaaaaaaagatctttgtcctaatgggctatgtaatcttttgcttttatttcaagatttattttagatttgaggatacatatgcaggtttgtcacattggcatattgagtgatgctgaggtttggggtgcaactgatcccattgcccaggtagagagcacagtacctgatagtttttcagcccttgccccactctgcctctccacttatggagtccccagtgtctattgtttccaccttcgtgtccatgtgtacccaatgtttagctactacttgaaagtgagaacatgctgtatttggttttctgctcctgctttagaaactatataatcttttgaaggagacaaggaataacatataaaacaagtgaagaaaaaagaaaacactgacaaaatatagagtaatgccttataacatggtaaattgaccataatcaaagactgtactctatgatacagacaacatcctccactggacattaaagattttagattaaaagcaatggtctgcttgtataaattttattattaaatcattaaattgcaataaagaattccttcaggtaaagactcttttaatacactatttaataaaaataaaagcagattatatgctctataatgattattcattattaaaaatgttttgtcctgaatatattcactcatgccaatcaaaaatccctgtaacaaagtccaaaattttctatttttggttttcaaaactacagtaactgcaattattatttataaacacacaatgaatattaacttttctttattacatttctggtggagtaatgcaaatgaatcacctttgaaaacaagagacacattgaattttcacagggccttaggagacacataacatttcattagattacttaattatcagaaagttaccaccaacagaataaatggtagcatcccagtccactaaaaaacgtgttttttatctcaaaaatgccatagacaggattaaaaaagcaattacttgtcacttctgcaaagattgtaatattcaacttactttaaatggaagatttttctaagggttagaaaattagctgctaaataggtcacagcttttgcaagcaattcatttttgttcgaaatattatcaatcagttgaaaaaggtaaaggacttctatgatgttatctcggatttggcagaatttaatttttgtctgtccatttctatttatgattgtatttacaggtgtcattcaatcattgtttcactcactcattgaggaagactcactatgtccttcagtattaaatattcattttcactaatacactaattgaatcttaatataaaaaaccatgcagaattatagtgtgaaataaaaaaattgcttttctttaaaatgtttctaattgtatctgttttgctttagacatacagcaatttcctgtttttattaagactacttttaaacttttatccatatgtgaaatcatcatatggaatctgtcctacaatcacactatttccccaactcattcatttacaatcacccagatggctagtttttgccttttctttcctcaaaattatattgccttcctttttattaagaaaagaatagctctaagaattcccacgagtcacacaactaaataccagaggtgaggagtctgtgttcctctgggaggccaacacatggggagaggtgttagagtccattgccccaacatactcaagggcattactcctccattctcttttcattttttcatatcaagttgttgtttctactgtatcattttcatcagcatataaacatatcgttattttgctcattttagaatgaaagtcatttatcatgtctctgctacctcagtaatccactaccatcagtgatcgtgtcctgcttctcttaatgcatcacgagcttcctcttaacctcaaggaaaaagacaaacatctcatcgggttgctgtctacctcttcagcttcagctcttccactctaagttcctgccattctgaattcacttctttctactcactctgctcctgagatttcataccagctgtgccaccaactggtacacactttcctgtgcctgccttccaccctactcctgtctaccctctttcctgtcgcctggctgcccctcaggcatcttttgggccttggctgacacagcacttttgcagggatcttgatatggtttggctctgtgtccccacccaaatctcaccttgaattgtagttcccataatcccaacatgtcacgggaacgaccaggtagagataactgaatcatgggggtggtttcccccaacttgttctctgtgatagtgagtgagttctcacaagatccgatggttttataaggggcttccctcttctctgggcattcattcttctccctcctgccacgatgtgaagaaggacatgtttgcttccccttccactatgattgtaagtttcctgaggcctccccacacatgcggaactgtgagttaattgaacctctttcctttataaattacccagtctcaagtatgtctttattagcagcatgagaatggactaatacagatctgatcctccagctagattagtgccctactcatgtgtgtgcccttctctatcagcctgtccaagtagtagagtgaacattctgtaaggtgaggactttacctcatttaccactgtattcctggcacttaacacaggacatggcatgtcaggcagtcaaaaagtatttgtatttgaatggataaatgaagaattgaggacattcaatactgttcaataaatattagcagacaattcagctgaagaaacaaagtttgtaataaaaatctagaagtttggttgtgaaacatgacttataaactcagattatacaggctagtataatttctaatatttaaaacttttaaatgtaaaagctataaaaaacacttctttcttaactaaagggaaatgcaaagttttcaccttgttttccaaaattatttcatatggattgattgaaacagtggtgggacatcaaaattaataaaattttacagccttcaaatgtctgatttcctaaaattttccctttttatggcaggtctcctctcttgaatttcacctgtaggattttatctccctttattttatgagaaaacacttcttttctttttttaaaaaattttgtaacgcaattttaaatttcaatttcttgagctttatacatgttagttgtaagcaaaatactcccatcttagatcagagcttttatttcagtgcatagttgtgataggaagtgaccctgagcgcctcatttaaaataaaaatcttctcactgtgtccctcccgtttgtcctggtcctggcctctctcatcacccagctttattgtcttccatggcaattatcaccattgggtcgttttgccattgactccttagtgcctgtctcttgtgttagaatataagccacatgtgggcaagtgtctcgtctgtgtttctcaccagtatataccaaagtgccttgtatgttatggagacttgattaaatactacatgagtgaatgaatcttctagttatttgatcaaaaaagctacctaaccatgtgccttctgcctgataataaaatgttatcattttaaagttttcttctttttcaaaagtaaagtaggtataccatccattgaggttagcaaaaggctagcatgttaaatacccacttcacttctgtaagtaagaaaaagctctgagctcctccataaagccacttcgctttctgcgttctttgaactgtattttaataaaaagtcaccattatgcaaaaaaaaaaaatgcatttgaactactggcatcttacactttttctcttctggaaggctaacacttgaaactacttgaagagaagtagctaaactatgaaaagtcactgaaaatcatttctaggaaatagaaaatttgccttttgctccttgttctgatttcacaaatgtaaattgatttcacaaatcagttttgaaatctgaattgatttcataaatctgattaaaaagaataagaattttattttttgtttttaaatataagatttatgtccatcagtaagtctttattcatgttcaatgctatttgtttatgtaaataacattgctatggtctgaatgttttttttctcccaaatccatatgctgaaaatctaatcatcagcacaatgacattagaaagtggggtatctgggaggtgattagattatgagggtggagtcttcatgaatgaggtctgtgcccttataaaagaggctgtagagagctagctagccacttccaccatgtgaggtcagtgagaagccatcatacataagtcagatagtaggccttcactagacaccaaatctgccagtaccttgctcttgaacttgtcgggctccccaaatgtgagaaataaataaataataaatatgtcatagcagtcaaatggactaaaacaaccacatattttaaatcattgtccaccaatacaggaagacattttttaatgttctgaaagtaatttcacttctaacccacagtcagctacatattgactatcattaactgaataaaaaagctttatcagaaagaaaaatactgtattcacttgattattttttccatcctgttttatttaaacatgtaattctcctctaagtgacaagtcatattcttgaaaatctcagaacctcacatcaaattcttagtccatctgccttttctgtaatcagtgaatgacaaattaattatactttattttagctgagttttatgtagacacggaaaggctactgcctactatgaacctgctttaaaaacaatgtgaagacttggaagtttatagaaatctaaaatcaaaaagagcaggtctaatatcctatattggagatgtttagtgccaaacggctctgttgtgatgacattcattttccttttccgtggaaaaaaactgtgattttcaaagcttgagagactttatggtcaatatcagattgccaaccttatgaaaataattgtcatcatctttgtccaaacaactacgtgtcagagagctacttccagatgtgctattcacttaatacacatattgtctaatccttactatatgtggaaagttgatagtcataccatttttgttttagatgtaaaagttaaaaaattgatagagctggccctagactcatctaaggctcttttcacaacgccgggctaaaaagcatcattgtgatttcaggtaataaccatcaggctaaaatactcacatacttctcaggcccaggaaggttacttaagtgagtaaagcaaagtagatgttgggttattacgaagaagagcacacaaggcccttgtacagggcagcgactcctcaggtcccaccaaaggctgtcacttgtgaatgtgcatctaaggtttctgattttgtaacttttcaggaaaggccagaaacctagatgattgtgggtatacaggcttatatgtgtgttttacacacacacacacacacacacacacacacacacacggttctgattttggaaggcaatcaaaatcatgtttaaagaaagtaatgtgggagccaaatgcaatatacaataactgggggaattatgttgcaacttctttgttacattaagaagattaaaacattttgaataaattttaatgaatttattatcagagcagatgtttaaaacttttgtgctaagtaagagtataattcagcctctagcacctaattcatgttttcagataacactttctatgcatcttcctttttctttgttttgtactttttggaccccttaaaagaatatcaccaggactaagacttgtactaggaaatcacttgaggcatcttgtaaacagaaacaaatttgacatccttctctcctggagtgaaagcaactaaacagaagcaaagctgtctagacagaggtagagcaatttttccctctatcccttattaggtgttggttctctcagaggaacgaaactgaagtggcaaaaaggactctttcagttcagttgtggctatgttttaaatacgcgcacttgtaacctgagttatgttttaaaactgattagtaaaagtgactacatgtatgaagatggataataagcgaccgctttccatacagagtacttagttgtactgttttcttatccccgctccgacgcacttggggagcacacacacttcttttcatgacacttcagagtaagttagcaaatgaggctgacaaatgcatagttttttttcccctctgaaattatgcaactctgtgataatttaaagaaaatctggtctgtagatgaaccaactgactaaactctgtctagatatggagatattttttgccacgccttgttagcttcctcttccccaagttttacatttttggatcaaagtgtgcatttgtacttggtgctttttatctcccttcttatctttaaaatttttattcctactttgtgtcttgtttctgtctcatctgtggtatatagaagtctcacagtgaagcatctcttttctcaaatctcttccctttaaaccttctaatgatgtcacaagaaataaaaagataataaaaacagcttaattcttaagttactatgccaaaattaaattgtatctattctagagaaatcatggtggttactggtgagatttaacgtatttctttgtgttggaaaacatttgaaatacaaacttcaaattactaaatggttaaatacaaggaaaaaagaaaatagcaattattaaataaataaaaaaaatttataacagttttagcagaggtttatattaatgtccagctatacagtttggaggaatgaagaatcttttctacctacccaacagaatagtaagaaataatcacacattgcatgtaatcagaattcagctgtcagctataattttctttatcatttagagaggagaaaccaggaagcaatagatattgtttcattaagaactgcatatgtgaaataactcttttagcttctttagctttcttcctttgatctaccattaactccttatgagaaagtaattagacagattttttttttaaatttcactggctctttgtgtttaatataagatttctttacaaattataataaattttgaactttttaatgttaactggagttagcatcttcaaaattatttgtgtattctgaaaacagcaagaaaatgtgattactgaaaatatttctgtaacatacaaagtaatgagttgagatggtaatattaactgcaaagagaattttgaaaaagtgattattgtttttagatggaacaatcatttaagtagtccaaatttgttttctcttattttacttatttttacttacatttcatcgcttttcagtcttcacttaaacatttcaccatataaagttccacagatgaaattaatctcatcctttttaccttgccaacatacctcagtggtactcaatttctttatattttgtctccctatctggttttagctcaaagaaaatttgcatggaattccagatttatgaacttaaaaaactaatagttctgatcatctttttacacagagataaactgggttcaataaggcctacatctcattgaactagggttgcaatatttagcaaataaaaatacaagtgtgaatttcagataattttttaacatatgtatgtctcaatcgctttttagtaaaaatatatcccaaatattgcatgggatatattatgctaaaaagtgatttgctgttcatgtgagattcaaatttaattggtcttgtattcttatctggcaactccaccttgagttgttttgggcattaaatcggataatttagctgacatgactgacaaatggtggatacccaacaatttttcttcttgccctatcctgcgaactcttaaagaaacctgtcttattgacctttaaatcaccagtgcttgattaaaagcctgacatatagtaataactttagttatgcatgtaatatagaataaatgaacgtgtatgcgtgcacatgtacacatgttcagaagctagtgttgaggattagttagtaggaaaaggggtggtttctatattaggaaagtgttacattccacctcccttttatcaagatatttcatcatctttttactgctgaccactactgtctagaattaaagacctagaaataccttgatagatattctttttcatacttctttcctcagagaacattacaaaaaatcattgttagataataataatgtgtaatatcattgaaaaactctaaaactgaatgtttacagtttcccttatcactttcccactatcagaaccacaataacttaaattacttttgagccctgttttgagaatagctgtcatcagcaccagttaaaagttctatatatgtatatgtgtaaaaaaattatatataagtaagcataatacatttataatgtctataaataaaacatgcataatgccatgctgaagcaggagtgagcaaacaatggccactgggccaaatatggcccaccatctggttttgcatgccccacccatgagctaagaatagtttttatattttgggatgtttgggaaaaaaaatcaaaagaagaataacgttttgtgctttatgaaaagtatatgaaattcgaattaagtaacattggaaaacagccatgttcattcatttacatattgcccatggctgcttgacactatgaaataatcagcttcatgtgtccactgtgctacactatagtactcagttatttaatcaaacaccaacctaggtgttgccgtgaaggtgttttgtagatatggttaacatctgcaatgaatttactttaagtaaaggagattatcctcattaatgtgggtggaactcattcaataagtcaaaggccttaataagaaaagctgaggttttctggaaaaaaaaaattctgccttcagactatagcattaactacctgagtttctggcctgctgacttaccctatggattttagacttgccagcccccacagttgtgtgggtcaattctttatacactacaacagtagaatcgaataattgcagcagagaatgcatagcccacaaagctgaaaatatttactttctggtcctttacaaaaaagtttcctgacccctgtgctagatacatactaaattggagctaaatcattttccttcctttgtctatacaattttgtgttcaattaatatttattgattctatgtaattaatatttattgatgcctattgctagctacgtaacaatagcatcaacaagataaactttctattctggtgaatcaaataggatggagtggagacagatcatgaatgtggcgacactgtgaaggtaccgataagtaagcaggtgtgctgagtgagcacgctagagaaccatctagtacaaacaacccctccataggaaagctaaatgaaactgtaccctcagggtgaaacatgtatgtgaactgaacatgctactttgccttatgcactttaagtaagtacatttttggatataagcctgctgtacatgtgttttgagcttcagaaaggaagttcagatactgtctaacagaagtcaccaccactgtttccatggaaggtgggtaattatatcaattaagcagttaggatgtagcacagtatggtgtgagggagactgtgaagtgtcagagcatgcaatctccaggcattgacatttacattggaaacattgagaaaggcatggtgcatgccaaacaaagcatattttcaggtttcaagagatgccaatttaaaatttctgaggtaaaacctagctcttctcacttcataaatgggaattaaaacccaaagatcttatgggatttgactgaaatctttccatttgtgacagcgatgagactggaatccaggtcttttggctcccactgcaattttctctcttccttctgtggagggcgcctgaggatgtgttagggtaggatcataaggtaagaaaatggaagtcaaaattaggctggagaagaatcttaccttcatgaaagagtttatgtccaagtaatgcattaattatatgtttaaacatttttgtaactacctattatgtcgctggctagaactatgcctggtgtcttgacgtttcaagaaagcaggtgaaaaacagtatctcattgtggtttcattttgtatttccctaattaataataaacacattttcatacatttactggccattaatttctacttctgagaaatatctgtgttttgtgtagttttccatagttccttttgtaatattcttactgacttacaggaattaaaaatattctgcatagtaatcctttatctttggtatatatatcttcttccattcttggcttatctttccactttctttatggtgttaaagttcttaatgcatttttgtctcatttatcttttttaaattgttacacatttttggtgccttgttttaagaaatccttctctaccttcacaccatagggaaattttcttatatactcagctaaaatagccttattctttttcatttttaaaatttattattaatattattattatactttaagttttagggtacatgtgcacaatgtgcaggttagttacatatgtatacatgcgacatgctggtgcgctgcacccactaactcgtcatccagcattaggtatatcgtccagtgctatcccttccccccccaccccaaaacagtccccagagtgtgatgttccccttcctgtgtccatgtgttctcattgttcaattcccacctatgggtgagaatatgcggtgtttggctttttgttcttgtgatagtttactgagaatgatgatttccaatttcatccatgtccctacaaaggacacgaactcatcattttttatggctgcataatattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttcaagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgttatctcattgtggttttgatttgcatttctctgatggccagtgatggtaagcattttttcatgtgttttttggttgcataaatgtcttcttttgagaagtgtctgttcatgtccttcgcccactttttgatggggttgtttgtttttttcttgtaaatttgtttgagatcattgtagattctggatattagccctttgtcagatgagtaggttgcgaaaattttctcccattttgtgggttgcttgttcactctgatggtagtttcttttgctgtgaagaagctctttagtttaattagatcccatttgtcaattttggcttttgttgccattgcttttggtgttttagacatgaagtccttgcctgcatcacgctacctgacttcaagctatactacaaggctacagtaaccaaaacagcatggtactggtatcaaaacagagatatagatcaatggaatagaacagagccctcagaaataacgccgcgtatctacaactatctgatctttgacaaacctgagaaaaacaagcaatggggaaaggattccctatttaataaatggtgctgggaaaactggctagccatatgtagaaagctgaaactggaacccttccttacaccttatacaaaaatcaattcaagatggattaaagacttaaacgttagacctaaaaccataaaaaccctagaagaaaacctaggcattactattctctttcattttttaagtcagacccacttggaattgatttttatatacggcataatggagaggtacaagtttgctttttcccatgtggataactaattgcccttgcataatttgttaaactgttcatccttgtcccattgatctttactgccaactcttcaataaatcatgtttctctctgtgtgtgagtttgtttgtactctaggcagtttgtttcactggcatcatttttcaatccatgtgtcaatgccacattgttttaattcttacagatttaaaataattaatttctggaaacaaaaatcctctcaccttgttttacttatttaagtgtgttttggttttttgtagaaatttctttcttccatataaattttagaatcagcttgtcacattttacaaaataaaattgaagtaattttgattggaattgaattgaagctatagataaattggggcagaattgaaatatttacaagacagtgttccaattcaataacttgactctatctctgcatatttaattatgtgtcttacatagaatgagttactattgttttttcttttttttttggaaacggagtctccctctgtcacccaggctggagtgcagtggcgtgatctcggctcactacaagctctgcctcctgggttcatgtcattctcctgcctcagcctccccagtagctgagactacgggagcctgccaccatgcccggctaatctttttttttcctggttgtttatttatttatttttattatactttaagttctagggtacatgtgcacaacctgcaggtttgttacatatgtatacatgtgccatgttggtgtactgcacccgttaactcatcatttacattaggtatatctcctaatgctatccctcctccctacccccacccaatgacaggccctggtgtgtgatgttccccaccctgtgtccaagtgttctcattgttcagttcccacctgtgaatgagaacatgtggtgtctggttttctgtccttgcgttagtttgctcagaatggtggtttccagcttcatccatgtccctacaaaggacatgaactcatccttttttatggctgcgtagtattccatggtgtatatgtgacacattttctgaatccagtctatcattgatggacatttgggttggttccaagtctttggtattgtgaatagtgctgcaataaacatacgtgtgcatgtgtctttatagcagcatgatttataatcctttgggtagatactcagtaatgggatggctgggtcaaatggtatggtatttttagtagagacggggtttcaccacgtaagccaggatagtctcgaccttctgacctcatgatctgccgcctcagcctcccaaagtgctgggattacagacatgagccaccacgccaggccattactatagtttttaacaaaacttagtacctggaagaacacacccccaccaacccaacacacataccttgttctttatattcaagaagtcttgtctattctgatattaattattaccttttaatttatctgagtttgtcctgctattttctaccttctcaagtggaatgcataggtaagtaactttaaaattttatctttactaatgtaaacattcaagggtgtaagttttcctgtagttactattaataatttatttgcatcaaataagtttttgtgtaaacatcttattattgagttctaaatatattttttgttgtagtttcttccttgatctttcatgacttacatattattgaaagtgaatttcttaattgcatcaatatattttattacaattaccttttggtttttgctttttaatataattgcattttagtcagaaaacatgatctgtatgatattaggtttgctttttagcccagataatgttaattttcagggatatttcttgtgattagcaacaacgtatattctatggtggttggggtcagtgttatatatatattcaaaatatattgcttattaattttactattctaatctatatcctgaggtaatttttctaattgttctgtgaaatactgagaaaggtaagctaaaatttcataatataattgtatttacttgataatagagaccttaagtctgtgcaagagtttggaagttgtacactggattactattctacttgtggtttaaaatttgcatgcctaactcgtgtaacaacacaatgaccttaaaacattgctgcttgcaacactttttttcctattattctattatttttatatattttaattctacattttacttctttttagtcccacaggtttttgttgtctgtatagtcaatatttgtttatatttacttacatatttattttctttaagcatcactgttttttgcatattagattatgcaactgcatccctttcttctagctagaaatttatcatttaagtttttctttagtaaagatctactggtgacaaactgtttttttgagattattttttaatttggttctcgatttaaaaaatgcaattcaatggctttccattgtttcttttgaaaattatttcttatgtatttgaggtatatactgtcacccaggctggtgtgcagaggcacgatctcaggtcactgccacctccacctcccaagttcaagtgattctcctgcctcagcctcccaagtagctgggactacaggcacgtgccaccatgccctgccaatttttgtagttttagtagagacggggtttcaccatattggccaggctggtttcaaactcctgaccttgtgatccgcccctcgacctcccaaagtgctggtgttaaaggcatgagccactatgcccagcttttttattactttttgttgaatttaaggttatttgtctttttcattctataatattactataatgtttctttatgtgtatgtttgtgtgtatgtataaataaatttttatccagaatacctatttattttcaaatttaattgatcatttaaaatagtctcttgcttcttactcattttctcagtgtattaaaatttaaacataataaggcacacctactttatgtgtttgataattgaggacttcatgtctaaaacaccaaaagcaatggcaacaaaagccaaaattgacaaatgggatctcattaaactaaagagcttctgcacagcaaaagaaactaccatcagagtgaacaggcaccctacaaaatgggagaaaattttcgcaacctactcatctgacaaagggctaatatccagaatctacaatgaactcaaacaaatttacaagaaaaaaacaaagaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagacaccatctcacaccagttagaatggcaatcattaaaaagtcaggaaacaacaggtgctagagaggatgtggagaaataggaacgcttttacactgttggtgggactgtaaactagttcaaccattgtggaagtcagtgtggcaattcctcagggatcttgaactagaaataccatttgacccagccatcccattactgggtatacacccaaaggattataaatcatgctgctataaagacacatgcacacgtatgtttattgtggcactattcacaatagcaaagacttggaaccaacccaaatgtccaacaatgatagactggattaagaaaatgtggcacatatacaccacggaatactatgcagccatgaaaaatgatgagttcatgtcctttatagggacatggatgaaattggaaatcatcattctcagtaaactatcacaagaacaaaaaaccaaacaccgcatgttctcactcatagatgggaattgaacaatgagaacacatggacacaggaaggggaacatcacactctggggactgtggtggggtggagggaggggggagggatagcattaggagatatacctaatgctaaatgatgagttaatgggtgcagcacaccagcatggcacatgtatacatatgtaactaacctgcacattgtgcacatgtaccctaaaacttaaagtataataataatttaaaaaaattgtaatatttgaagtcattaagaatattattgtatttttcgtggctcctgtttgtctttactagtggcacttttttttttgcaagttttaagtgtttgctgctgtagttgtcattattctttatttttccttgtaaaagtaatttccaaagataatatatcacctaggtctcagggcgtgaccaacttgcagagattcaataaaagttgttggcttcaaattatttttatactatctaggtagtgttaatttgggctgaaaacctataaagactagaagatagataataatttctatgaaatattttgtttttccatctaccctctgctgttgagagaggcgattttcttagctagtgtttgtgtgtgtgtgtgcattgaaatttccagtttacccttatacttttagccatgggatttcacttttatctgtagatgggtaaatctatttggttctccactggaaatatgtcctaaaatttatctcctgtccttaaacatatttcccaacagtttgagaagctcaagttcactagtgaagcaaattttatcagggtgaaaggcatttttgtgctctgtttatctctttgaattcttaagttcacttagcttttggcttctgtgtatgttgtttcctagttcatcaaaatgtctaacttatcattttgtcagaaatagtttcctcaaatttcaaaagttttatctctacatggcttgctgctatttttttattttttagtgcctagaggttttataatgttcatattaaaatatatatattgtaccccttatcattatatggtatctctttttaatctatttagtggtttttactttaaattttatcttgtttaggattgatttttttttttgccatatttaccaggtatttctttacacctttatttttaacttttatttcttacacatttcaaaaaacatcttacggctgggctttgactcttaatgggaaaattcagtttatatacattgactctaatgacttaaatggtaaattttacttattcaattatcctccattatttattttacactatttctttttaatttttatttatttatttatttatttatttttttgagacggagtctcgctctgttgcccaggctggagtgcagtggcgtgatctcggctcactgcaagctccgcttcccgggttcacgccattctcctgcctcagcctcccaagtagccgggactacaggcgcccgccaccacggccggcccggctaattttttttttttttttgtatttttagtagagacggggtttcatcgtgtttgccaggatggtctagatctcctgacctcgtgatcctcctgcctcggcctcccaaagggctggggttacaggtgtgagccactgcacccggcctataatttttttattattatactttaagttctgggatacatgtgcagaatgtgcaggtttgttacataggtatacatgtgccatggtggtttgctacacccatcaacctgtcatgtaggtcttaagtcccacattaattcggtatttgtcctaatgctagccctcccctggccccccactccccaacaggcccctgggtttgatgttcccctccctgtgtacatgggttctcattgttcaactcccacttatgagtgagaacatgtggtgtttggttttctgttcctgtgttagtttgctgagaatgatggttcccagcttcatccatttccctgcaaaggatgtgaactaaccttttttgttggcttcatagtattccatggtgtatatgtgccagattttctttatccagtctatcactgatgggtatttggattggttccaagtctttgctattgtaaatagtgctgcactaaacatacatgtgcatgtgtctttatagtagaatgatttataatcctttgagcgtatacccagaaatgagattgctgggtcaaagggtatttctggttctagatccttgaggaattggcacactgtcttccacaatggttgaactaatttacactcccaccaacagtgtaaaagcgttcctatttctctacatcctctccagcatctgttgtttcctgactttttaatgatcaccattctaactggcatgagatggttacttcattatgcttttgatttgcatttctctaatgagcagtgactactttaaatttcatatggaaccaaaaaagagcccatatagccaagacaaccctaagcaaaaagaaaagccagaggcatcacgctatctgacttcaaactatactacaaggctacaataacaaaaatagcatggtactggtaccaaaacagatatatagaccaatgtaacagaacagtggcctcagaaataatgccacacatctacaacaatttgattttgacaaacctgataagaacaagcaatggggagaggattccctatttaataaatggtgttgggaaaactggctagccatatgcagaaaactgaaactggacaccttccctacaccttatacaaaaattaaaatggattaaagacttaaatgtaagacctaaaccataaaaaccctagaaggaaacctaggcaatacaattcaggacataggcatgggcaaagacttcatgactaaaacaccaaaagcaatggcgacaaaagccaaaattgacaaatgggatctaattaaactagagagcttctgcacagcaaaagaaaccaccatcagagtgaacaggcaacctacagaatgggagaaaatttttgcaatctatccatctgacaaagggctaatatccagaatctacaaagaacttaaacaaatttacaagaaaaaaaaatcaaaaaatgagcaaaggatatatgaatagacacttctcaaaagaagacatttatgtggccaacaaacatatgaaaaaaatgctcttaggtatttactgataggactttaaaactgtgtccacacaaaattgcacctgaatgtttattgcaggtttttcataattgcccaaaactcaaagcaaccgaagtgtcccttagtaggtgaatgggtaaacaaactgtgatgtactaagacaaggaaaaactatttagggaaaaaataaatgatctacccagccacaaaaagacatggaagaaatgtaaatatatattgttaattgagagaagccagtctgaaaaggctataaactatataatcccaactatatgagagactggaaaaggaaaaactatagaggcagtaaaagagaccagtggttttcaggggcttacagggaaatgggaagatttgaataggtaaagcacaggtgatataacagtggtaaaattattctgcattatattctaatggtggacacgtgacatgatacatttgccaaaagctacagaactttacaacatagagtgaactctaatataaagtatctactttagttaacaatagtatattcatatttattcatcagttataataaatgtgtcacactaatgcaagttgttaataagaaattgtgtatggaagttagggtatatataactctgtagtatgtgctcaataacagttaaaaaatttttataaagtaaaaaattcaagtattgcatactagcctatggtaagtaaagaaaacaccaaaagaaagggtgccagtgtgtcattctgtcctatctcttcctcagatctgttggaaatgagtgtcagactcagagttcattatggctcagaattcctggaggtattttgatgtggaacaggagagaagcagaaaaataagtggatcctgataaaggcaatggctgtgaaggttaagcttcagggctctcaatttgcaagaaacttttttatggctgcgagcttacattagtattgataatttgtattattttttaagaggtccactccctcaaaattatataaacattagtccacacaaaacctggaaagaccatataaaagaaagtctccaaaggctttgggatagtgagtacttagtctatacttcattcatataggtctttttactttgtccactaattgtatttttataataaatgtcttattggactgaaactgtccaaactgatccatcttcttagaaattcaccaaactctggaattttctggggtctgaaacataaaagccaatgtgattcagcttttaatcatattatatgcttcttaaataataatttaaagtattttagtataggttttgccagatgaaggagagttgacatattaatagataacttcacagaattatccattcaagtaaggataggaagttatctgaaatgaaggataggctgttgttttacatcattttttttgtttccttgcttccttttaatcccagtataattagaaacacttcctattgtattatagagacagaaggtctataaatactagttagatatttttatgagcttttctacttcaaatgaatcatatgtggggcaaaatagtgagctattattcaatatgttggggctaatggagctttaaataaaatggagccttagaaatgaaatgtttctaaactcaaatgaatgttttatctttaccaaggaaaatatttccccacacaggattagaattatcagtttgcacttttgctgtctgagagtgccatataacaatgtcttaaccattaaaattaatgacctggaatataagaggcctaaatagccctattacgttgaaaaaaattctatcaattctcaaaaagagtgaaatagatgttacacctatctaaaagatatgcttcatggaacaaaaaattgtgaaactacagagaatccaaaaggtttttaaagtatttttaattgaaaaacttctgcatctcagaagatggcttcacagcaactttaaagtaacagaatgtatttaatttaaggatatacttttgctggtgaatattaatcatgttcacctagataaatggttatcaactaggagtgattttgttccccagggagcatttgacaatgtctggaaatatttttggtcaccacaactaggaagtggtatgactgtcatctaagtgagtgcaggttagtgaacatgctacaatgcacaggacagaccctacaaaacatgtcaacagtgccaagcttgaaaagctctgagtgagacaaactgctgcaaataaatatcaagtttgtactatcaagttttggggtaccccaagaagtagcaatggttatggattccctactcatttcttctgctataaccttaggagtcttcgcagactgctgtcaatgtgagggctgggtctgctccatgtgctttcctttgttggtttctttcataccatgaactgctcagatcaatccctggagagggagaccaaactcaagttggccttcaaaattccattcccagttattttctgagaagcatctctaaaatcatgctgtaggaagatgaagaaagatatgttctctctccttagactctacccatcaccactcaaccaaagactttcatgttgtatgaaatttcttgtttattttttagaaaaaaacgaagcaagaaacaattattttttacttaataataaataaaacttatttcagaaaataagttatgtgctagctggcaatattcttcattcaagtgtgaaattggattaggtctacatgaagaagcatagataatcgaaaacagtatcgacagagtttgtaatgggttgaatttgtggcccatcaaaatgtatatatctacctggaaccagaaaatgtaatcttgtttggcaaaaggaccttgcagatgtaattaacatagaaccttgagacgagatcatcctccatgagagtaggccctaagtccaataagtatcctttgaagaggaaagagaaggggaaaggatatatgaggaagggtgatgtgaagatgaaggcagagattagagttatttagcccaaagtcaaggaatgctttggagacaccaatagctggaaaaggcaaggaaggattctcctctacattcctttggagaaagtgtggccatgccaacacttcaagttcagacttctagtctccacattgtgagaaaacaaatttgttgcttttaagtaactcagttatggtaatttgttacagtagccctcagatactaatacagagtcaaagacctgagagatataaggtggcacgacaagagtttcctctatgtccaggaagccctgaagggagaggagtaatatgtctgataattccaggtcatttgagagattgactataaaggcagaaatgagtgtcaaaatgtgccagatgtctgctgtgaagggtagcaatccatgactggaagccagttcgtgaacagagtagccaatggactcagtgtctgaaagggcctgatttcaacattaaatgaagctaaagagttcccaagtggtgggcaagccttggcagtagtgatgccctctgtttggtggtgggcattactgtaaatctgagaatcagtgccttggatgcaggaacctagtcacgagccagagtgaggacatatagaagagtgtaagggcatctgagtgagccagactgcaggtcaagggaagcttttgttcttggagaattatttgggtcccctaaagtacagcatccactagactaattggaaggcaatgtagctcatgcatgcatggcttctatgggattatgccaaaacttctgcctctgaccacgtttttctgtatgttttaagattgaatgtgttacaatgacagctaataggagatggaaaaagaaaaggagggacattaaaaataaaaagattgtatgttaaaaatacagagtaagaggataaaacaattacagaactataccaataacaatagtaaatatatttgacttgtttcaggtctagagcaatacctgactcatagtaggcactccataaattattactgagttgatgagtaaatttatgtacgaatgaacaagtactttgagggagaacagaaaaaataaaaattgtattcagttatttaatcaacaaattctatattgaagccatagtgccaataattacaactatcatttctttcttaaaatacattagtatccaatataaattttatgccttccaaggttcttatctttctaccttaagaattaaatcacatttgactatatatgaaaataaactatttgaggctaaaatacctggcattaaatatttaggtacattaaataaactacagcatgtaattaaaaggggttaatatggagaataatttatttctgtcttctggaaacatatgtattgatgtgtcagttattctttctaagactttcatgttgacattgcaggtcattgcttcaaagcaatgttcttcaaatatctgattttattttaaaagcaaaagcactcacaatcacttcgaaagaagatctggcagtttctcataaagttaaacgtaaacctaccctatgcaatttcactgttgggaattcacccaagaaaaatgaaaatacatgttccccaaaagacttttccagaaatgtcatagcatctttttttaattgtagcaaaatacaggatactggaagtagtcaaggtgtccatcattaggaatgggaaatatacaatgaaatattactcagaaatacaaagtaatgaactactggtacactaaaaaaatggatgaatctcaaaaacacgctgcaagacttgcatagtagtacatacacactatatagtagtttcatttatatgaagttcaagaacaagttaaactaacatagaaaataatagcaaacagtggatgcttctggaatttctggggaagggattcattatgaacaagcacaagaaaagtttctggaatcatgttttaatatctaatagggatttgtattaagttcatgcatttgttgaaattcatctaatggtacatcaaagaattgaatatttcattcttgtgaattttacctcaaagaaacaatttgcaagcaaatattgagctccataatatgcacactacagtgtttaggagtgtagtggactgaaacttgcagctttgaaatgtatcaaaaaatgcactgatggattgatagagggatgggtagatatgtaatgaaatatttctggtaaattgttaacaatagaatttaagtggtggtaatacagttataaggattctttcagctcttctgtagtttgaaattgtcataaagtgtagagaaaaaattgaaagcccttttcatagctcatgcttccaatttctaattaagattcacagagggattgcttaaaatcatttaaaaatattgtatttccatagaaaccaaaaaaatttgcataattctatttctttacaaacttttattcaatttagtttgtctacttattaagatcagtcgtatttgtactattcctttgtgttttccagtttttaaattataattgggtgatgcactttgatctttataatcatggttaattttatacatgcacacaacattacaatttcttggtatagttgattcattagcctgacgataatgacctgatggatttcaatttgagcactttcttgaggccactgaaggcagtttatgtagaagcagaatgaaatggtaaatttgcagctagttgaagttttatgctttaaaatttcactaaccagaacacataatctagatttgcaaattaattcttcttttttataatgaaagtaattatgtgcagacatacagttttgttcaggatattttctgaagtaatttagcgttgacccaatctctaaataaaccaggtgccaggatatcctgctatttcttaggatgatttacaggcaccccttgatggtgaaacgctgaagatcaccatgtcaaaatgccatgttgtcatcaacactttgtggtatttgtgaaaggctttcaaagggaataggcattcatacacacacacacacacacacacacacacacatatatatatatagagagagagagagagagaaagaaattcactgttagtcaatacagacctgcaagtggccttaccagttgcttactcaaagtatactctattttttagagaaagtatctcattagtaggcattttacttgttatttgttcagaaattttagtgaatgcatcaggtttttaatttgaaggagtaattggtatatgcatcttcccctgcccaaaataatctacctggtaagactcacttttaaaaaggaacacacatgaaaaataatttgattaagaatttatcttcttgaaagaaactaaaaattataaaaataagtttattctattttatatttaatgtgtagattttataaattagaacactatactagttattggtataattcttcttaaaattagtctaatagcacaatatagcagtatttataccacatttgactcttcacgttttgttccagagacatttttgtgaaaaaatattagaggacttcactggttttcccaagggcctctcttattattttgttattcaaataactttttgaaacatcttttctgtcatacaacttatttttgattctctaatttcaactcattgttatgtggtttaaagttgctagatcagtggcttttaaagtaatgattggctttatgaaattctgtgacttttgtcatatttgcaacctgagaattgattttcttgtcatgaattttatgatatgtgaaaatcataaagattacaacatcgaaagatgggacctggattgatcatgatagccatatgctaagcaaggaagaatgagagggctgttgtgttactgatgcatgtttcacaccgtgacaggcttaaccgtcttacactatattgattgtggcaactcagattatagagcatttgaacaatgaagacttagaagaaagattttttgatatgtatttgctatagtttgaatgtttcctccaaaaaacatgttaattttttttaagttcaggggtatatgtataggtttgttacatacatatatttgcgtcatgggagtttgttgtacagattatttcatcacccaggtattaagcctaatacccattagttatttttcctgatcctctccttcctcccaccttccaccccgtaataggccccagtgcgtgttgttctcctctatgtgtccatgtgtcctcatcatttagctcccaattataagtgatgacatgcagtatttgattttctgtgtgtgtgttagtgatcatgttgaaatttaattgccaatgtatggtactggacgatggggcctttaagagggtgttagccctcatgagtagattaatgctattatcctgggagtgggttaattattatgggagtgagcttctgataattaacccactcccaagttcggtccccattttgtctctatcttgtgtgctgctcttccaccatgggataacgtaacacaaaggccctcaacagacatggtccctcaatcttggccttccaaggctccagaacgaggagcccaataaatctcttttctttataaattacccagtctgcagtattctgttatagcagcagaaaacagactaagagagtagtactattaaatataaagaacttcactgatgatagcttgttataatagggaaagtttacatactagctaatgcattacctcagtcttaattatctgaaggatactgcatgaagtttgggggagtgaaaaagatgtgagaaggtaagggaagaaaatgggctctttttacaaaatagggagaattcatcaaggttttcttcatatgtgaggtttatgccaactttatttttttgagggagtctgtgtcacccaggccggagtgcagtggtgcgacctcggatcactgcaacctccgcctcccaagttcaagcaattttcctacctcagcctcccaagtacctgggattacaggcatgtgccaccacacccggctaatttttgtattttttagtagagacagggtttcaccatattggccaggctggtctcgaactcctgacctcatgtgatctgcttgccttgacctcccaaattgctgggatcacaggcttgagccaccgtgcccagtcaggtttatgccaactttcagatattgtttatatagctgatgcaagcatgtacagatctcaaaatttttctgtcattcttctgatctaaatatatgtgaatagtggagtgctatggggtaaagacccattattaaaataatttattctcacctagcttatcttgtgatgtgaaggatggcgatttcactgcagcattatcgttcatgtgttccacaaaatcatctctgtgagaattctgtgtcattcctgtgtgtggggattatataaccggtatttatagtaggaagcttttctgtctgatttcctccaatattggttgtaatattatgcagccttttaaagccatttatgtatttttggattatcctaaagccatttgtagaatattaaatatgtattttattacattgttacacagctaaaagagcacattatactttagaggcagtaaatattagtacatgaaatcaaactgtctttagtatctcttctcttattaaaatatcagacttttctggctattctctgggagggttagccacagaaaagaaacaaaataacggtatattacagtaaatttacatggctattcaaataaaggtttagaacctagattacctgaggtaaattttaaggccaaaattacaaaaatgtataaaatgtaaatattttagaaatccaaaatgaatgattatggtgtgtgatagtattttgggttacaagtatatttatgcttagtttctcttaatgagctattttaataaagttttgaatgtaagtatattattaatttaagatattatatttgtgaccataattatgaggaaaaaagcaaggacagtagaagtaactgcaaatattaaatcaaaactggagaaagattctgtttctatgtgcatattccactgtaattgctcatgttaaaccttcaataaatgtttttgaataaataaaagcatgactaaattgattaatagatactaatgttctcttgcaatgaaatgactaggcctcttcagagtttaatttttttctactatgttatttcttcttcattttactatatatattttgcattgacatttcagcattaagggaatatttttactatctaaaaataatgagctagtaagccaagcaaataccaaggaaatgaaattgtgcttaacaactgccatatcaattttcactttaaaagccactccataaggtgatatttcttaaatttttaaaattataaatccaagtgatagatacagtagcttgagtaaatctatcactctataatacatatttttcctagtaataattatgctatatgaatagcacaaggttaatatttcaaagagagcataattcatatgatatcatactggtcatttcttgagactttctctcttttcagtcttattaattcctcctctcatggatcctgaaaactgattaagctgaaatattttgtcatagttgcatctaaacatggactcagtttctcatatcataactgaatatacaattctgagttctttagatactgtatattcatatatctgcataatggccatgcaatcttaaataccatttatgctttccctccatttgattatcttccagcaggctttctgttctattcttgattatattctttctgcagtaacttttcaggatctcacttctacaaggctgttttttaaatcaaatatttgtccttattagtcccctccctctgcttttagaacagctcttgttcttaaatttgaaaatctttactagtttctctttctgcctttagctgctgcccttgttctttcttttctgcttaaccactctctcagcttattttcaaatcacctcctgacagtctggttgtggctctgttttttaatggaaagtccagtatcatttctatacttttatttttctggatctttgtattttacacaatgacgtgtcatgagccctgaacctctctctctttgacttcctttatggtatttctactctagtttattgcctgcctgtttaataactccttaatcttctgtctctttatttgtccttttccgcatgtaacgctaaattttggtgttccctatgtgtaggttacaacttactttctacatatcataaactttaagaatttgattaatgctgctctgatttattttctttcttcctttctgaataagctaatttatttttaaaagacagcttcatatcactatggaaaatcgatcattagcattttccaaaaatggatggtagctatattagtttgctaggggctgccatagcgagttatgttacatagactgagtagcttaaaaaatatttattttctcacagttttggaggctagaagtccaagatcaaggtgttggcagccctggttctttctgaaggctctctccttggcttccagacagctgccttctctctgtgtcctctcatggttttctctgtgagcctgtatccgtggtgtctccttttgtgtccaaattctcctttttataaggactatagtcagattgaattaaggcccatactaatagcatcattttgacttcatcacctctttaatgccctatctccaaatatagtcacattctgaagtactgggattgagtatttctacacatagattgtgagaggaaacgactcaaaccacaacagaaactttaaaaataatggcaatgattaaattcaagattgatatttcatattctcaatggcgtcaatttgactagattaagaaatacctagagagctggtaaagtgttatttctgggtgtgtctgtgagggtgttacagaggagattggtgtgtgaatcagtagactgggtggggaaaatgtaccgtcagtgtggctaggcaacatccaactggctgagggcctgcgtataacaaaaaagcagaagaagggtgaattctctctccctactggagctgatacacccttctttgcctgcccttggacatcagaacttcaaggctctctagcctttggactctgagccttgcaccaatggccttccaggttttcaggccttcaaccaatgactgagagttacaccatcaacttccctggttctgaggcttttggacttggatttgaactgagtgtcttggggtcgtgaatggcctgttatgaaacttctcagcctccataagtgcatgaacccatgcctctaattaatctcctctaatctatctatccgtctatcttccattggtcatgtctttctggagaaccctgcctaatgacattactccaagattctaaatctgagatctgcatttatttttaattggcaaatgtagacaatttagagatacaacaacaaatggagactttaggtaatctgaaggatcaaaagacagttgatagaaaaataactttttattgggtattaaaatgtcaataatattggttcaagcagtgcttaaaatcatttctcataccatcaatgggtaaaattaaatttgctctcagattttgacgtgtcagtcactcaatctcatggagtctgttttcacccttatgtgaatgatatctaccctctcttttccttggctgaaattttgctaaattaatctaattcatatatatatatattttttttcatatattaatctaatttaattcatttatatgcatatatatgaattaaatttagcaaaatttaattttgctaaaatttagcaaaatttaattcatacataattatatatgaattaatagattaatatttaaattatatatgtttatatatataaaatgtatccatagatgtttacagccttttgtaatttataatatttataatataaaacagacatgatactgtttaaccttctcaaaaagaatatagtttggccaggtacggtggctcacacctgtaatcccagcactttcagaggcggaggcaggcaggtcacttgcgatcaggagtttgagaccagcttggccaacatggtaaaaacccatctctactaaaaatataaaaattagccgggcgtggtggcatgtgcctgtaatcccagctactcaggaggctgaggcaggagaaccgcttgaacccaggaggcagaggttgcagtgagccaaggtcgcaccactgcactctagcctgggtaacagattgggactctgtctcaaataataataataattaataatttaaaaaatatagcttaagagaagtaaaatattgagttaaattgtcactgtgtaatttctaataatctcatctagagagaaaatctggaagtatataattacaaaagtaggactactcaaataatttaccgattaggtcagatttttaaaaagtcatgaataaaagatagatgacaagctatataattaacataaatacaaataaattaatacaaagaaaacaataagtcccaaaaggcaaaacaccaagataaatgacaaaatgctaattttataatgggaagaatttaaatctgattatatataaaatacatatattaaaaatacacttgtattttggtacatatatatacactcatacatatatgatttggcttccacaccaaatctagctcacaacctgctcgtgtacaatttgtgagatggagtactttttttttttttaacacctttattatttaaaagtcaaaaacagatgctggcgaggttgtagagaaaaaggaacacttatacactgttggtgggagtgtaaattagttcaagcattgtggaagacagtgtgactatttttcaaagacctaaagacagaaataccattcaacccagcaatccattactgggtatatacccaaaagaatataaatgattctattataaagactcatgcatgcgtatgttcattgcaacactattcacaatagcaaagacatagaatcaacctaaatgcccatgagtgatggactggataaagaaaatttggtacctagacatcatgaaatactatgtagccataaaaaagaatgagatcatgtcctttgcaggaacatgggtggagctggaggtcattatctctagcaaactaacacaggaacagaaaaccaaatattccatgttttcccttataagtggggatacatagaggggaaaaacacacactggggcctattggagggtgcagagtgggaagagggagaggatcaggaaaactaactaatgggtattagccttaatacctgtacaacaaaccctcatgacgcaagtttacctatgtaacaaacctgcacatgtacccctgaacttaaaagttaaaaaaaatttcaacataagttttgaaggggacattaaaaccatagcaaatacatataaaaaaacctttctaaatcttcattgttcaagtgctctataatctgagtcatgagctcaactgaaaaagtctctgctttagtgatagatgaaaatgtatttactagcaaagcctctgagaagcccctgaaaatgcatagtatttcaaaacacaatgaatagtttgagttggaaccgatcagaatagaaaatgcatcagcatgatatgtataagactgtataagtgttatatttgtcaattaatgtaaaaattattacatttattaaatgtgatgaaaacctctatatatacaaaatgaataaacttgcatgagggtcacaattccgttaaagtttctggctttgaattaaatgtagataacagtctaatccagagacttatgaagcattaatgtgacatgttaatgccttaaaatatattaacagtgaaacattagagggcattttagaagacagcatttcaaatgatctaaatgtaaattaacctgatatatgtggattacaccttttttataatgcgaatgggtttaaaatgaaggaaacattgctttacaatagtgaacaattctatacacataacggtttgggctttcaaacatatgttcaaacatctgaacaatggtatggttgatttcacaaactctaattgtgtccagagtcatacattcatcattttgagcaattctcaatgttggctattttcaagtgattacacagaaatctttttggatagtcatacataatgcctttttatcacctctacaaaaagtgaattataaatcaacttaacgtgaaaatgtgtacagatcttaagttttaacctagaaagggaactgaaatgcaatataaactccttgtgtaagaagaaaaattcaccttggcttttgccttctttttccttttgttttattcttctcgttgtacaaaatgttaactgtgtacaggttctttccagaactcagctttggcactgcacatgctaatttgaatatgagaactaatcttaagtggctcttttgcattttctgccaatatatgacagatgtgctgcactttggaatccacaacagatatgacttttagattcttccttaaaccaggtgctaaaaatgtgtgaaaaagcaaaagacattgttactgaaaagtttaagccatagaacatttcattaatggttttgtggattaattaaagtgcatcttgttatagtcattttccatctttcttttatagcagtaggaagaaatatatgcaattattcatgacaatgcacattccacaggatatacttccacatatcccagagtatgtacacactaaatacatattaatgtctacacagattaaagatgtatttaagtaaataaaataccataggaagtcataatcatagaaatataaaaaggtgtgactaaatattatatataataaaggccctctaaacctaattgtcaatgagtatatgtggctagaacatatttatggaattcacatttatgttatggaatttattatttgattaatggaagggaattacaacaaggttaactagtaagtccttgtaatgtgccatttgatatgcatataatatgtgtgtaatgttccatttgatatgtatgtaatatatatgtaaaattatgcaaatctgattgagataataagtaaaatttgtcaaaggagtcctagaaaatttacaaaataggttttaaatttccactctagttaaaatgattgcaagtcatttcattgtctttattctgatttctattatctaaagatctagaggataatgttcagtggtttatgatactaaaattgagatcaaaatttggttgagttgcttgaatttcttgagagtaataagtatttatgaatatatgaaatatgaaaatgaaggattgttttcaatttattcaggacaagaaattctagcaaagtttcagtgatataccaaaaatattttatctagctgttgagttgtcatgttttaaatgctatgataaccatgaggaagcttcctggggaatttttaaagttttttttcaagtgtatttgtaaatatcgtagtccaaatattttatacttgatttacaaaagaagcgaagggtaaatgtaagtgttataaagggctcttcagtgaattaaagttaggagagttgcctgaatattcagggcacagattgaaatgaatataaaattttaaaatatgttcaaattcagaactagtttgagtggaggaaaagtcagagatagtgcctctaatttgctataaatggaagtaatttctatattttttcattttttccctaaataccaaggtatttgccaaatatacccaaatagctaaatgattacttacctatttacaaaaaaatccagttattttaaaatgtaataaaaatgtttaattttttttctatatcccagatgctatgctacatgccagggaaagaaaaaatataaaagcaatgtggtcactttctttaatattttgccatctaggagagagactaagttaatatactgtgaaaagtgaagatgttaaatacaatagagaaaggcataggatactatagaagtgtagatgataaaaaatgacttccaagcaaaactgataattgatttgagcctctaaagaagaaaaataggtaaccaggttaagaaatactgttccacatgaaaagaacattggcgggcatgggacatgacacaagaagacatgaaatgttggagaattaaaatgcacttagtataattagattctaggtttggatggcaggaggttgaaggaaaacaaagctggacaagttagcaggcattggattgtgaaggacacatgtcagataaataaatgtattttgaaaaagaattaagcacagatccattggaaaagaagtcagtaatggatctagatcagtgaaacagctaggagtccaagagaagaccccaggtaatcatgtgcaagaacaaatcatattttcaaactctaagagacaaacaaagtctctaaattagaaataaaaaattaagaagtgataatatggactttaaggtattctctacaattccaaacagcatcttttatccccaaatcctttgtttctcagaagttgttttgattgtgagtgatgtcagagaatgtgcctaagagaagcccatggtagaattcccattctgataaacacaaggatactctactgttgaattcaagtggtcatagggggatatattggtgtggtggatgctgtgaagctctgccttcacaatcctgctacctcccattccccacatattgctgatcttgagagtgcttcctttatacaattcctgcataacaatccccgtcttggattctgcttctcagagaacacattctgcaaacaatgggtagcaaagtaagagaagaggctgactgacaagcttttctgccaaggtaaagggacatccttgctggtgaagcatgctttcagaggctgctccttagtccgaagaagtccagagcaatggctgaacagaacccaagagatttcatgttagacctgagcatcaataaattttgagctaaaaggggctctcaaagacagagaaactgaaggtcaaaaaagtcaagattcccccaaagttacataactaattgagaattgggctgagactaaattccctatcttcccactcccagtctttttcaataaacctgtgcttttcaaatagatgtgcctgcaggataacagatttgcttgtagtcatagaagaaacataaaatgaatggagaatgattttacttactgtttatatcaaaatatatgtgttgtagaatgtaaacaccatgtgacttttatgattaaaaagtaagagactaaagatcttcagaattcagctatgtcttcggaactgttttgggtatagttgaatctcctctgacactaggtataagtcagtgtaaatatttgaaatgaactgcagaaagagccgagaatggtggctcacacctgtaatcccagaactttgggaggccaagacaggcggatcacctgaggtcaggagtttgagaccagccgggtcaacatggcaaaaccccatctctactaaaaatacaaaaattagcagggcatggtggtgggttcctgtaatcccagctacttgggaagctgagacaggagaatcccttgaacccaggagacagagtttgcagtgagctgagatcaggcccctgcactgcagcccgagtgacagagcaagactccgtccccctgccacccccaagaaaaggaactgcagaaagaaataccattaatcctcaagagtggattcatttacatcttgataataatgtgttctatctttatgttaatataataacatctataagaggccttttcctattttctctaaattcttattaaattttccaaactgcaaacaatgggtgataactacctccccttctaaagatgggtattaaacatatctaggtggtacatgttcattggcctagctaccatctccccaaatcttatgaaagttagagtttatcaaagaagatgattcttcagaggaatttaagagtagaaagcactgaggcatatcctacccccaccacaaaccaagtgaggaaatccccaaaagcatcattcagaaatagttgatagtgggacacatgctagcagagctgaagcagtttgtaggaatctctgttgttgtaggaatctctctgttgctgtctgtgtagagagacttcttgggaggactagacacatgatctatgagaactgcagaaatctcagcacataatgactctatctaagcctctgcattaagagaggaccacagtctagcatgatctctagcagcatgaggccctgtccctaggatgaccccagttcccctgcccctccattgaaatgcctacctgagaaagctcaatactgccaggtgaatttatttgcttcagccatgcctgaagacaggcctctgacctccctttcttggaggatttactaaaaagccttacaatcatgactccttcttgtgtccctttgagatttattgtatctcttacaactcagaagtttctttcttaaagacagacagagacattcctttgaaatgtaatcatcaagaaggacagaacctctgttctatcctatctctgtgggaggatagaatcttgacttgggagaattgccagctagcagacacagttggcctaatcacatttacactgaccaacccttagtaatttttcatttctctggctctacttgagtccctacttgtccccctcacttaaaaagactcgatcacacaaatcagaatggagctcagctcttcgcctactgtcagtagttactgaataaaatctgttttcactgctttaagtaatgtctagccttgtttgcctttgacattctacaattaggaagcaggaaatggaaactggggcctgcttcttgctgggagaatcttgaaagcagttggacagctggagtagccggcaaagttattgaagaaagtgagaattcacccatgggtttatttacacttctcttagttggcagaaccgtgatgcctgagattttctgggatccaattgatgatgaggaaggtaacacggctcaagtcatctagaaataaccttgtctaataacatgtcaaccttgtcatgtgcaccagccaaaaacagcaggcatgtacttccctgagagctgctaaagagagtttgcaggatattagctgagagggcaaaacctacaacagggaaaggtgttgtggggaatcaccaacaaaccactgatgcagccgcaatgacagaatgcatttgctgcccatgcggaattataatgagcacctgctaaggaatatgacttttgatgcttttcctgatttctactatcctgatctgaccttgaagactctagctttgaggaggaagtggatcaaagggaagggcagaagggtgtggacagtttcaaattgaatataagagggaagttttaaattggattagatttttcaatacctacaagtgacctgagagctatgggatattcccaggttgtcacaaactaagagggtagagaaatctgatagaacatttcaatagtcagtgttagaagaaatgaaattattcttgagtacaatctaccaagtcaggtcatttaataactgaatgcattactatctcaatatagatgacattatttttgtttttgtttgttaagaaagaatttttatagcagcatgatttataatcctttgggtatatacccagtaaagggatagctgggtcaaatggtatttctagttctagatccctgaggaatcgccacactgacttccacaatggttgaactagtttacagtcccaccaacagtgtaaaagtgttcctatttctccatatcctctccagcacctgttgtttcctgacttttgaatgatcgccattgcgcatgtatgtttactgtgccactattcacaatagcaaagacttggaaccaacccaaatgtccaacaatgatagactggattaagaaaatgtagcacatatacaccatggaacactatgcagccataaaaaatgatgagttcaagtcctttatagggacatggatgaagctggaaaccatcattctcagcaaactactgcaagcacaaaaaaacaaatagcgcatgttctcactcatgggtgggaattgaacaatgagaacacatggacacaggaaggggaacatcacacaccagggcctattgtggggtgagggggagggagagggatagcattaggagatatacctaatgttaaatgacaaattggtgggtacagcacaccaacatggcacatgtatacatatgtaacaaacctgcacattgtgcacatgtaccctaaaacttaaagtaaaaaattttaatagaaatgtatagcagtttgagataacaatttttggcattaaatacaccttggttggagttcttgctttggtaatcacaaattactgagttctggtttgttgaccccacaaattattttctctgtgctcagttttttcaccaggagaatgggaatatgaatagttatagtttacatattttgtggtatattcccagcccactgtaattcttccttcttgggcagctgctttctaatctgcaggtagatcaatgagctgactttcagcagactggctggcatggcatactttgggctagagccattggatgaggggtagttcccttagctaaactggacagccagtatctcttccccaggttcaatctaagaatggttcagcccttccttgggagaaggactctacaatgttcattcaaaatccgttgtcaatcaggacatggtaggaaaaatgaaacatgactcgaacagagaaaatactgagagtgcctttgttcctagttgtagttcccttctgcaaacatctttgcatgctcattctagggttctatgagattccatctttatattcatataataagtttgaatctaacgttgtttattttaacttggattagataggtagaatagttcaaaaagcttggattccaatctcaattccagaatttactggctgagtaaccatggacaaaacacttaaactctctcctccattttttctcttgaattacggggataggataatatttacttcaaaatcacactatcacactgattcatgaggattaaatgagtcactgcaagttacttattattgagttggtttctataacttggagacagaaaaaaccttcaactaataaattatcacttgattcacagaattggtgtgtggaatgaaagagaaaatgcatgaaaagagtttaggacagtgtgtatgtaccaattgtacaatggtaaatattagctgttattatctattgctttcctatttcttagttactacatttgtactatggtttgaatgtgcacccccaaaacatgtgttggaaacttactcctcagtgcaacaatgttggcatgttcggtgtaatgagaggtgattaggtcacgaggacaaagtgaatggatttatgccagtatcacaggagggaattcattataaaaggggtagttgggctccctttttctttttctctttcattgtttttctgcccttttgtctattatcatgggatgatacagcaagaaggccctcaccagatgtgacctcctcaatcttggactttctagtctccaggactatgaaccattaaatttctgtttattataaattacctagtctgtggtattctgttatagcaacagaaaatgggctaagacaatctgatattacagtagtttttccttattttctgttttgctttcctcagtttcagttactccatgggcaaatgccatccaaaaatattaaatagaaaattccagaaataattcacacattttaaattgcacacctttctgagtaccgtgatgaaatctcacaccatccccatccatcccacctgggatgtgaaaaattcctttgtccattttatataagaaacttgattgtttatggtatctgagaggagtcctggagccaatctcccgtaaatacaaaggatgactggatatagggcttggtattatttgaggtttcaggcatccactgcgggacggtcttagaattctatcccctgtggagtagtggggactactgtaatcttcagaaacattgagattacacaaagtttccatttcctacttttaaaccacaggcagtcaagagaactgcaggcaaaaggtggcatatttgtgtgaagattaatttccatattgcctcatatctcttcatatttattcaggtccatatctatgatcctaggacagagaatagagacattcacagagaaaacttaccaaaatagattaaagcaattgaaattgatttaatattcccaggacagttaaataataaattcttctactcagatagttttcaatttcattaataagattgtatttacaagtaagggcatgatgttgtcttttacatataaattcttaaattaagtttttcctatcaaaggcacatcgcatgttgacaacaatgtctgaaaatgaatttcccagagaccacacgttttgttcttaattatctctgctcattatagtttttccttgttgttttgccattgtgtaataacattttaggtcaggttcacattagcccttgtttttactgttggtctgttttcatatcatccaaatttatactcttcaatccttttccctgatttattcccattaactagagaatagtattttcttacacatccttactattttattgtaaatagtataatacaaaaatattaatgtagttcctctaccattatttaaaatgttaatatgttaaatgacattgagattctcaactaaaccctattaatttagttatctgaaaatgtgttctcctatggaaaagcatagtgttttctttgaaagactatgagttgcagtatcagaaaaaatagccatatttagcatttggccataaaactttattgaaattcatgagatgagggacaataggctgattacaaatttaaaatacatcagtgaatgaaattagaggcattgatttttcttcagtaatttgttttagtcttatattaagtccaagaaaattatcggtacttacagttttccttttaaaaaaaactcataaaaatcattcttatatactcatgttcatgacagcatactattctctttggaactttctttcctctgcttttcaaagttctggtgactttctattttttaagttttggcttaaatggcatttcctcattgtagatttttaaaaaggcctttctccactcccagtgcaccccgtcctggaaccattaaaaattaagttgcatgatcactgaataccaatttttttctcattcttcccactgtttaaccattgtcacttaaaagtgatttctctggcagtatataagaaattataatgatattttctactttccatttttgttagcaaatttattttagaaaaaaatgcttttaaacatgtctgtcaattaaaaggacaattagtaaattcatcaaatgttaagtttctatacctagagtaaaatgcgtatcctctagagataatttggtacaattgaggtcattagtatcttatctgtttatgcaattgtttattacaagtatatacaactcaatatatttttcttgcaattcaacttggaatatacccctgaaaaactctgggggacacatgctgtggtacattttctgtatggaccttgtattctagttctacacttgtctttaactagtagtttacttaagttactaaactttttttgaacattgtttctgcacctctaaaatgttagtttcaatagtgaatgattttaataattctacaaaaactttaaacatgtactttatttatcttttatgtgtcaaattatctttatgtgtgggtatacacgtaatgtatataataattgtattaaaaacaaataggaatgcatgcaatgaagtcatggctgttaagaaatttagccctgaattagaaatataagataaatcatacttcccagtgtgcatgcatacatgtacttgcaaatgtttagctagttgatcattcatgctttgactgtaaccttttgtagaataggcctatatcattttctttattatccatatcttttgtgccatggtcaagttttactgcatataattcagtttttctgtgaataggtggggcagaagatagtgccaaaaagaaagaatggaacctttactgtgacttgttttctataatcacattttataccacatatttttgttcacaaaataatacatgaaaggacataagccttatccagtctggtaaattttgggttaaaaaaatctatactgtattctgcacaagagaacacaaagatcttctatgcttccaaattattagaaagcattagggttaaaagagttttcatcctattttttggcctgttgtaattatttctcaatttttctccccatctcatcttcttccccaccataatcctttctatattctactctcagatctatcattctgaagtccaattctggtcattatgtcttttgattgattgaaaaccattctaatgttttatattttaatctgtcatttagggttctctgccatatgaatcacacctgaatttccagctttatttctcagtcgattccatatgtgccctgctcccaaactaaactagacagctctcttctccttcaagtatttgttcattctggtttcttttaagtatcatttaaactgatccttttaagtaccatttaagataatattttctccataaaatatttttctcgatgacctaaattgaaagtaaagggaaaaatctttgtttatggaaatgttttggtgatgtatttacattgtgtttgcacagatgaaaggcaacaaaaagttttgctaaactattctgcaaaataaatggacataaaagacagaaatccagggagaaaaaaaatgtgcacacatgctatgaatgccttttgtgaatgattttttttttgtgttgaaataaagaagaggcctgttttgtgatatcttggtggattgtattgtctagttactatttcacaagcccaaggaaaaatggcccctcttgttcctctccttctcttgcacaggcagtgggttagcatatggttgaggttttgccaattagtcaatttcagactgtctcctgggactctgaatcttgagcaagtggctcagaacatggcacatgtccagtgctgggggcggatagaccagtctgctcctagatcagcctcattatagctcttgttccctggctttccagaacattgaacatcctttgatacattttctaagctgatttcatttacttccctcaatttgatgaacactagatatccactcaataggtttcctttttcgtgtaatcatgtaagtctcctgaaagatgaccagaggtcctgtggtaggcagaataatggcctcctgaagatgtccaaagcccaattcctggaaactgtgcctattcccctttacatgacaaaggggaattggggatgcagatggaattaagattgctaaccagctgactctgagatacagagattatcctggattatctcagtgggccctatataatcacaagcatccttaagtgtagtaaagggtggtgtaagagtatgtctgagagatacaatatgagaaaaattagacttcccattgctttctttgaaaatagatgggatcatgagccaaaagatgcagacatcttctagaagatggaaaaaacaaggaaatgcattctcccttagatactccagtaaggaacacatccctgtcaaaaccttgatttaagctcactgaggattgtgtcatagttataagtatgagaatagggagcaggctgtctttgtctccagctgagcccagtgttccctgctggagaatgtagtagttcatagtgaagagcagagcaggttataaacctccagtctacctctgacttcaaaaatgaaatcccctgtctttgataataggtaatcttgtctccttttagtcactgttcttgacttcaattcccatttattttcaatttaacatctcagtatttcagccattgtcatttactaataaatatgcagcattgctctctgatttcatacagattttcagacatggatattaacatttgaaaaggcaaacacctgtttcttggtccttttctgatgatgtagaccatcagttctctggaagagataaatctctgttgtaagaactttactaatgctctgtttcccttgccttcttagctatggaatacctgacactcagacatctgatttaaagttaataaataaattcggactactcttgtacacttttaatatattccagttatggcaaagcaaagatatcaaggcagtctatttttttaacaagacaaaacacctagtaaagcctctcacttttatttctacttttgtaatttcctcagtacagttaacctttaaatatatatgtaatatatgtagatagaatatcaattaaaacaaaatatttcttgctgttaatgtacggcatttaaatactcctttattttactatttataaaactgttttatagaacactaaaaggtatgggcctgtttaaaaatgttaatcttataattaatagtcagaggcatacgcttttccccaacacaaggcactgatattctaaatctgtcattctgaactttacagtaggagacagccatctgcctgcatgcagccatataaaacaaagcaagaatatatgctcttatgtttcccttggtgagatgtaggatcattatgataaagtaggcaacaaggtttagctaatatgaattaagatagcatgtgttgaagaaaaaaagagcatattaaatcaaactaattctataagtcaacgttattagctgattggatgtggatgatttgataaagtagagcagcatatgatgtaatgtcaagtagatgggaaatatgtctgtgggtgacccattccttagtctcatagctccagaaaccctttctctgtgttactggatctagtgctattttagttaaggcctatactttaattgacaactctattttgctgtgtaacatgaaagttgttaaaataaaatattttaacattctttcacaggttaagaatattaactagaagtaaaaaggaatgaggcttgggaagaaaaatcagtttccaacatatctttatatctagatgtctacgcaattatatattttttcagtcatgttctttcatcagttatgtctagatttttctgaaatttaaatactctaaaatctgctttttatattttagtttaagtgaaatcattatgaaaagatatgaccactcagacacaattttttgggctcacccaatgtgtttttcagtttaattttatggggattatgatatcttcttcattaaaaacttactagatcaacattaacttctttggtttgacgatttttgaaatcttattttttaaagaaaactctcttttcttcctaaagcaaagtttttttttcataaacagatgacagagtggaagaatttaaaaattttgttatgccatcacattaaatttgattttccagctagtacagtaatatagcatggtggttaaatgtgaaatctggattcagccaagattacttctaatcccatttctaccatgtacagactgtgtgaccttgacaaagtaatttaacaactcaaggctttagatctctcatttgtaaatgggggtaatttagagagcctacttcagcagggttattctgagggttaagtgaaataagatgtatgaagcactcagtgtagcatctggtaaatcaggactcttcacaataatattatgcaaatttcattcctgaagcagaagttcatatattttaggtgttgattgtactcaataagggattcatttaaacattattttcatggcactctgtctgtaaattctgatttatctgtaaatcgtaagcatttaatactaagaacatttctaagaagttatataaatataagtataataaatataaatagagaagatttagggactgtttatccaaagcaaggtttttaccaggcaattgaaacaatttgaaaatggcatataataattattgaaatttacacttaaatttcatcatctatagcatgattcaggtttcatctggccaacctgagtcatgctataaaaaatgacatcctaggaccagattcctgaattacagaccttaggcagtagcagtagtcgacatgtgtcagtatggattctaaggcacacaacatcacagattacatttagagcaataggttgaaaacacaatcctgcccttggctttctttatgacagaaagaggcaagatactctattcaaatgtaaagagtaaatggttaaaaataaatattcatcactttaatatttacgaataaaatttcagttctgaacatgcatatcatatggcactctatgtactatactgaaacattttccaaaagaggcaacaacaaaaaaattacggataatattatgataatctaaaaatagtcctattacattaattttgtttagtatatcatgtgcctcagtattaatgaattaaagttattcttcaaatgcaattttgtaattactaattattgataaaaatattagtcatagtgtctgattatcatgtacttttaaaaaagaaatactctatagattacttaatggttagcaaaacattatccaatttattagtttttaaaatattataaattcagcaagaaaaatagttaaaaacttaagaagtataaaatgattaataatatgaaaacataatttctacagcaaaaataggatagatttccaattcttttcctgaggtcactttcctatattctgccaccaaaacatcaaatacaattaaacctccgtgaaaccttgcttaactccaaaaatcctccattgtttttttctggaagaaaatacagttactctatgaagtgttaaagatactaggtaaagagttaaaggagagagaattggagattcagtgggacagagagaaatgatggcttagagggtcattgctagtgtaatacgtgtgtatgaccaggagatacactaacattaaaaaattaaaataggccagtcacagtgactcacatctgtaatcccaacactttgggaggctgaggcgggtggatcacctaaggttttaggagtttgagaccatcctggctaacgtggtgaaatcctgtctctactaaaaatacaaaagttagctgggtgtggtggctaatgtctgtaatcccagctactctggaagctgaagtaggagaatcacttgaacctgggaggtggaggttgcagtgagccaagatcatgccattgcactccagcctgggcggcagagcgagactccatctcaagataaattaataaataagagtattttttaagactccacctagcacaaaattaaaaagataaaaagccctctcagaattttaaatagttaaatgtagatctaaaacagctttacaacccaaattatctccctagatctctctactcaaagaatataatataaatggccttaaattatagcagaaagcaaacatcatgatattttgcaaacacatgaaatacttttctcaaaatcaagccatagtgatgtatcttcagagcattttatagataaaatcaattttgaagaacacttatatgatgtcttaagagaaacatgaaaatagactgtgtttccatttctgtgccttttactatatttgcttgcttacttagctaaatattaaacattcacagtcacacaaagtcattgtggaagaagggtggaataacacacatgcacacacatccacatccacacacatgcacatacatacacatacacaaacacacccctttgaattaacattaggatgtcccacattttagcgcttaaatgggaatttattaaatacagtcttggataagtaataaaattatctgctatctgaatcataattcagtagtaatccccatcccttcctccctaatttagaactggagattagttgtatagacacaatgacacttcagctatcagtgcaaggacaacaagtcagctgcagcatgacttaatgcctttgtaatctgtccagggtgtttctggctttagttgtctagcatttccctaattaactgaaaacatcttaggaggctattagatgttgacaataggagaatatatttttttcattcattaacagcttcattaatgttaaaaccatattcttaagcatcaaaagttaatgtactattcttaaacactaaattcaaatatgaggatttgcatatgaagtatataagtgtggctatttggcaattaagcaataaaatagtattaattagaacctaattgtctctgtggaaacaaaggaaagattcaccataattttagaagtaactacataaaaaacactatgtttgaattttaacttctattttatatggcaattggaaatatatgttgaatggcattcctaatgcagaaaacatcttaggtttgcttctacaatactaaactgaaagtattcgatcagaattcatttttaaataaaattatacagctgtttcttgtttgtgctagtacccatcactaagtttacaatacatttcaactcctgtccattctctggagaggtttttaaaaagaaatacaaaagggtaatgaagattgattacctttttcacagaagcggccagtgaaatgtagtggacagtcacattggaatgacactatgccactggagaggaagatggcatggcatgtgcctccattgtggcatacatcctgctggcacacagagggtgctgcaacagaggggctgacagaagtccacatggtatcaaccccttgtgtcacatcagaagcatcaacaaaggaggctgttggagacagcataaatccctgggatctgtgatttataaacagacaagaaaacaaaatataagtaaaagcactaggaacataaatagaaataatagaaaatttgatttaatataagagaaaatgaaaccaatactgatcaaggtttaactgaggacaaataaaattatcatgtttgtttcacaattatgagatttgtaaatgttaaaaatttctgagccacataacatgaccctgtagtagtaagaaacgtggaagaaataaccttcataaacttgtcagttgttttatggaaaaaacatagtcctcctttagctgttacaaatcttatgagcctaagatcaagaattaggtcatgttacatcttcatgctaagattgtttgaacttgaaggatttctgagttaactgctagaaatgtgcattcattagtctgacttagcattaatttctgggagctatccaagaggtaccttagaaatacccataaatattccctaattttttttttacaaattttaataccagtttaattttttctttacaataaataatgaacaacaacaaaagtctctctgaattatgtgaaatttcctacttttacattcaaaaccccttgacaatctgattcatccctgctcttccagcctactttatcatgattcctaataagtaccttaaattctctcaaaccaaataagattgctattccttaaagatgctgaaatttcctaatattggaagtttgtttaatatactttttatgccttgttattcctcaattcctgtctaaatttcacctacagtgctaagcccacgcctgcattattttttgtccctggcccaacaagatgaaactgtagtatagttattttgtgtgtagcctctactatttagatgtatatattcattgttttttctttctccctccacacaaaagtttctcattttatcagaaatctttattcataatacttaagaaaatttgttgaattaatgtgttcagcatactcatgagtttcatatactgtctgggaaggtttttagaatttcacttaatataataatgagataattatctttttaatgtaaaaaaccttgtgcaataaaaatcaacaattaaacataataaatttttattttataccttgtcataaagataaaaccttagcaaaagaagtcacttcaaacattccccaactgatcttagagacttaaaaagctatttttatatctactacgcacgttaatgtcaacttattggaacaaaagatttaaagaagatgaaatagataatttatattttactgatacattaatgtgcaggtcagttctttcgcaacctgaaattcttctttatggtgttcatcacagattgtaccaatatatttattttcatgattgagcctgacctgcttttctttcctctggattgcaatctacatgaaggatggtgggatgacttctgtgcttttcttcattttattcctaacgatgcttgatctctagtaggctctccagtaaatattgtataaataattttgaatctttttttttgtaaatatgcaatgtatcacactactttctgttattgttgttgtttgtttgtttgggatgaagttttactcttattgccgaggctggagtgcaatggtgcgatctcagctcactgcagcctccacctcccgggttcaagcagttctcctgtctcagcttcccgagtagctgggattacaggcacccgccaccatgcctggttaattttttgtattttcagtatagacggggtttccccatgttggacaggctggtctcgaactcctggcctcaggtgatccaccagcctcggcccccccagagcattgggattacaggtgtgagtcactgcacctggcctgtaccacactactaaagaagaacaatagcagtgaaataattttgtcaccccaggttaattttatagctccattatgtaactctttagttttataaataatataagttctaacacttttgatataattttgtaatcaactttctctgatattgctctatcagaaaattagcatacatcttcctattagtccttgcgatataagtttgtctctttaaggcaactttcatcaagttaaatggcaatgctaatatgaatgacatgggatttattactcagtattctgaattctaatttaatttttagttttaatgtttctgaataatttcaccatttctaacatttgccatggacttcatgaactgcagtctgtcaccactttctcaggaataaattagaattaaatgccactacttctttctcctgctgtagctgctcagggagcctatgtctcacctgaaaaaaatcaatattttgcacatttcagttaagtgattgcacaaaaataattgctatcaattgatccgaaaacatcaggatcacaaatcaatttttgaaagaaacattaatcatttgatctttgttataaagatcaaatttcatatctgatatatgataattaatagtctttggctttcagttttatttttggaagttatagatgatgtcacaaatttacttgttttaaaatttagaatgaaataaaatgtattcaatttgttatatatttaaaaaggaaaattagttcacactgctaaaattttaccttatttttacatacagtttaaaaatatcaagtgactgtggaggtttattaaacataactagatgttggacttagtaatataattagcaatgtaaaaaaggaacagtaaaattaccatttttaaaattctagaaatcataaatgtatgagagtttagaaaatagtaagtgtgaaaatctgtctgatcgtttcttaggtaactttgtataaggatacagtgacaaaccagccattattataacaagaaattagtcttcaataactttttcttaatgaattagtgtctgaataacatatgctcaatggattcaaaaccaaacttgatcactggagaaagacaccttgataggacagcaatttccagtcgtgttggggaactctagttggaacaggaaaggaacacacactacttatttcaatcccacagcaagcagcctgtgaaaaccatggggctaaacacttcacattgcttcagcctgaaggattttgctcattgccagctgactttaccactgctcaacagacatttgtctggcacaaatgtttagaaggaagagtgggctcacacagatatgtgcctacgaacctggcttctcaagtacagaagtaggatcatttttagaatgatgatgaaatattaaaaagaaacaaacgctgccagaagacccttgagtttagagctttaatagtgtaaggggaagaaaggattcaaaaatcactgtgtttgattgtaaagagtagtaaaataaatgaattataatctggataacaaaatgcatatatctcatgtaaagaaaactcacttttttttttacaaaaatgagaatatactctaaacacatacttcattccactttgtctttccatttattagatatgctattctactctttgttttttcacctaaatgtagtttttggtgggctgctccattcataagaatagttcttcactttccttttaaaatctgcagagtgtttttattgtttggatatatcatcatggattctatcagtttgtaactgatatatttaagttgttttaagtttttttcttgttatctgaatcataactttattttcaatagttacattgagatataatttgcatacatagtgtacccatttaaacagcattatttaatatttttaatagatacagaattgtacagccatcaccacaatctagctttatattttgtcattctcaaaagaaatgtcatttcccttaacagccactctccaccatatatcctcagtctagtcttagtaaacgtttaatctacattctgtctgtagatttgcctattttagacctttcatataaataaaatcagataacatatatagttttggactggctttttcatttagtgtaatgttttcaaggttcacccatgttgttgcacgtatcagaactttattctttttttttttcttttgagacagagtctcgctctgtcacccaggctggagtgtaatggccaatcttggctcactgcaacccccgcctcccgggttcaagcgattctcctgccacagcctcccgagtagctgggattacaggcatctgccaccacacccggctaatttttattttttgtatttttattttttatttttttatttttattttttttaattattatcatactttaagttttagggtacatgtgcacaatgtgtaggttagttacatatgtatacatgtgccatgctggtgtgccgcacccattaactcgtcatttagcattaggtatatctcctaatgctatccctcccccctccccctaccccacaacagtccccagagtgtgatgttcccctgcctgtgtccatgtgtcctcattgttcaattcccacctatgagtgagaatatgcggtgtttggttttttgttcttgtgatagtttactgagaatgatgatttccaatttcatccatgtccctacaaaggacatgaactcatcattttttatggctgcatagtatgccatggtgtatatgtgccacattttcttaatccagtctatcatttgtggacatttgggttggttccaagtctttgctattgtgaatagtgctgcaaaaaatatatgtgtgcatgtgtctttatagcagcatgatttatagtcctttgggtatatacccagtaatgggatggctgggtcaaatggtatttctggttctagatccctgaggaatcgccacactgacttccacaatggttgaactagtttacagtcccaccaacagtgtaaaagtgttccaatttctccatatcctctccagcacctgttgtttcctgactttttaatgattgccattctaactctgaatagaccaataacaggctctgaaattgtggcaataatcaatagcttaccaaccaaaaagagtccaggaccagatggactcacagccgaattctaccagaggtacaaggaggaactggtaccattccttctgaaactattcccatcaataggaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaatcgaatccagcagcacatcaaaaagcttatccaccatgatcaagtgggcttttttctgtatttttaatagagacggggtttcaccatgttagccaggatggtctctatctcctgaccttgtgctccatccgccttggcctcccaaagggctgggattacgggcgtgagcaaccgtacctggcccctttattcatttttagtactgatatggatctatcatattttatttatctattcattagttgaaagatgtgggacttttctactttttggctattgtaaataatactatgaacattcatgttcagatttttgtctggatgtatgtttccatttctcttggatatgtaattaggagtggaattgctggattatatattctacgttgaacattttgagcaactgccaaactattttccaaagaggcttcaccgttttacatttctgccagcaaaatataagagttcaagttctccatatccttgttggatcaaacattcgtttttctttttttgacttttaaaacactatttaatgaccatcttatcaattccattgaatttaatctttttgaactgaaacctgtatgcttttcgttacaaataatttcatatgtattctttttcttccttttttttcaatttgctttctatttctttcaggtttttttaattttttaattttttatcttttatttttatatatgtatatatttattatactttaagttctagggtacatgttcacaatgtgccgggatagatacctaatgtaaatgacgagttaatgggtgcagcacaccaacatggcacatttatatgtatgtaacaaacattcttttttctttgtatctttgacaaaaatctccccatttcttctatcccccagatcctggcatcataaactcttataagtagtatgtacatttaattttttatgaattttgacaaattcccctcaggagtggttgccacaatttacatagtaacaacttttactctacttataccaataatttctttatcaaattttttgctgtttaacagccacttacataaaaactagaaacttgctgttgtttcaaattatatttctttattaataagtgtcatatgcagaataattcccacctccacttaaattaaaagtagttttctgaacttgcctaactaatatctgtttcattcacctggagtcacacagggcagaccaactgagtaaaaccccttttgcaggtaatgtatagtaaaggctgtgatggcttaccactctttctaagccccctatttctctaattatgcattatcaaatgttatagctataaacacatacacatgtatttaatatacctatgtctatatctacatctacacctacattaataacttgtatcatctcttgtactatttcagtggagttttttagttgccaggtgttcagttttcacacagggtaacttaaaacaactagtgatgtcttagtggtgtggctaacaggaataaatccagaaaataattcaattgctgttttaactttcaaaatcataagaacatcataacatctaataaagctttaaacaaatggaaaaatgacttcaaaagtttgaattgccagcattctcagctagttccaaaattttatgttgtttttagtttgattaataactttgaaaataattaatcattgcaaattttatgagagcaaagcaatacagaaaaatgtttttgctatttaaaaaacatatataattgtcattatattaaaggaggaaatatgcaaaattactgttagtacatgaaaaattctcatttgccattcaaaataaatgttagatagtaaaacaaatcatacaaggaaaaattaatctgaagaaacaaccccaagtgttactcctcttttttgaatataacatttatgtaataggataagaatcataccttaataagtttagtaagattatcattttaaaatgcaaataaattaattcactccacataatagtgtaattttaatggatcttgttttcatattttcctaatttttctcacgggacaaatgcatttctttctcaccatcttctattctttagctattacacagtcacaaataggattccttagattacaagctttgtcatatgattcatgttccctgcatccttgggtgttaggcaggactggcacctcagggcattgcagaccgctgtttcacagtatgaagggtggatatttttgaaacattctctcccccttgatagattctgattttactttctcatgccagagtacagagggttattattattgtttttatttcaatggctttaggcatacaagtggtttttggttatatggatgaattatatagcggtgaagtctgggattttaatgtacccctcaccctgtattgtacattttactctaataggtagtttttcatccctcatctccctcccactctccccacttctgagtctccaatgtccattataccactctgtatgccttgcatacccatagctaagctcccacttacaagtgagaacatgcaaaaatcatgatttttaatggctgtttatgttccatcctaaaactacaccatcaattatttagtagtttctctcttgtaaaatggttaaattatttccaattcttgtattccttttatgtttttaaattatactttcaagttctagggtatatgtgcagaatgtgcaggtttgttacataggtatatacgtgccatggtggcttgctgcaagcatcaacccatcatctacattaggcatttctcctaatgctatccctccactagctccccatcccctgacaagccctggtttgtgatgttcccctccctgtgtccatgtgttctcattgttcaactcccacttatgagtgagaatatgtggtgtttggttttctgtttttgtgttagtttgccgagaatgatggtttccagtgtcatccatgtccctgcaaaggacgtgaactcatccttttttatggctgcattgtattccatttttgtacatgtgccacattttctttatccagtccatcattgatgggcatttgggttggttccaagtctttgctattgtaaacagtgctgcaataaacatacatgtgcatgtgtctttatagtagaatgatttataatactttgggtatatacccagtaatgggattgctgggtcaaatggtatttctagttttagatcattgaggaatcaccacactgtcttccacaatggttgaactaatttacactcctaccaacagtgtaaaagcattcctatttctccacatcctctccagcatctgttgtttcctgactttttaaagattgccattctaactggagtgagatggtatctcattgtggtttgatttgcatttctctaatgacaagtgatcatgagctttttttcatatgtttgttggctgcataaatgtcttcttttgagaagtgtctgttcatatcctttgcccactttttgatggggttgttttttttttttcttctaaatttgtttaagttatttgtagattctggatattagccctttgtcagatggatagattgtaaacattttctcccattctgttggttgcctgttcactctgatgagagtttcttttgctgtgctgaagctctttagtttaatcaaatcctgtttgtctattttagcttttgttgctgttgcttttggtgttttagtcatgaagcctttgcccatggctatgtcctgaatggtattgtctaggttttcttctagggtttttatgattttaggtcttacatttacgtctttaatccatcttaacttaattttgtataaggcgtaaggaagggatccagtttaagctttttgcatatggctagccagttttcccaacaccgtttattaaataggaaatcctttccccattgcttgtttttctcaggtttttcaaaggtcagatggttgtagatgtgtggtgttatttctgaggcctctgttctgttccattggtctatatctctgttttggtaccagtaccatgctgtttttgttactgtagccttgtagtatagtttgaagtcaggtagtgtgatgcctccaggcttgttctttttgcttcggattgtcttggctatgcgtgctcttttttggttccatatgaaatttaaagcagtttttttccaattctctgaaggaagtcaatgatagcttgatagggatagcatgaatttataaattactttgggcaataggccattttcatgatattgctacttcctatccatgaacatggaatgtttttccatttgcttgtgtcctctattatttccttgagcagtggtttgtagttctccttgaagaggtccttcacatcccttgtaagttggattcctaggtattttattctctttgtagcaattgtgaatgggagttcactcatgatttggctctctatttgtctgttattggtgtataggaatgcttgtgatttttgcacattgattttgtattgagactttgctgaagttgcttatcagcttaaggaaatttggggctgagacgatggggttttctaaatatacaatcacgtcatctgcaaacagagacaatttggcttcctcttttcctgattgaataccccttgtttctttctcttgcctgattgccctggccagaacttccaatactacgttgaataggggtggtgagagagggcagccttgtcttgtgcctgctttcagaaggaatggttccatgttttgcccattcagtatgatattggttataggtttgtcataaatagctcttattattttgagatacattccatcactgcctagtttattgagagtttttagcctgaaggcctgctgaattttgtcgaaggccttttctgcatctattgagataattatggtttttgtcattgtttctgtttgtgtgatggagtaggtttattgatttgtgtatttgaaccacccttgcatcccagggatgaagccgacttggttggataagctttttgatgtgctgctggattaggtttgccagtattttatttaggattttcacatcgatgtttatcagggatattggcctgaaattttctttttttgtgtgtttctttgccaggttttggtatcaggataatgctggcctcataaacgagttggggagaattccctctttttctattgtttcaaatagtttcagaaggaatggtaccagcacctctttatacctctggtagaattcagccatgaacccatctggttttggactttttttggttggtagctattaatttctgtctcaatttccaatattcgactattcagggatttgacttcttcctagtttagtcttgggagggtgtatgtgtccaggaatttatcagtttcttctagattttctagtttgcgtagtattctctgatggtagtttgtatttctgtggggtcagtgttgttgtctcctttatcattttttattgtatctatctattttgttgatcttttcaaaaaaaacagctcctggattcattgattttttgaaggtttttgtgtgtgtgtgtgtgtgtgtgtgtctctttctccttcagttctgctctgatcttggttatttcttgtcttctgctagcttttgaatttgtttgctcttgcttctctagttcttttaattgtgatattagggtgtcaattttagatctttcctgctttctcttgtaggcatttagtgctataaattttcctctgcacactgctttaaatgtgttccagagattctagtacattttgtcttaggacatctttatttctgccttcatttcgttatttattcaggagcagtttgtcggtttctatgtagttgtgtggttttgagtgagtttcttaatcttgagttctaatttgattgcactgtggtctgagagactgtttgttatgaattctgttcttttgcgtttgctgaggagtgttttacttccaattacgtggtcaatttgagaataagtgcgatgtggtgctgagaagaatgtatgttctgttgacttggagtggagagttctgtagatgtctattaggtctgcttggtccacagctgagttcaagtcctggatatccttgttaattttctgtcttgttgatctgtctaatattgacagtggggtgttaaaatctcacactattattgtgatcatagagaagaggcaaactctctgccttttgataccagaacccaaagctggatgggaattagattgatactttctgcatttaaaccaaatcagaaagtatcagaaatgggatttttctttcttccctccacacctcaaattctaagttttttttgttgttgttgttgtaaaataccctctacatgtttcaacagttttatgttcatatttcctttttgacatccgtgactttagctcctgtcatcctctaatccatccttctcactgtgttcatttttcttgttgtattactctcagccccaattttttccaattcaaagtattcattttctattatttgtatcatcccactttttggtttcatcggcctggaatgtcttcctctatatcccatgtgtgttctagctacatctaaggataatattttcaatattctatgccttatgattttcatatgctgaggttcctctgagattaactttaaccttaaaatctcacatttttcatccttcaaaatgcagttcaagtttttaatatatataatataaatatataaaaattataacatgaattatataaatatataatcatattaataaatataatatattcaaatatagtattcatatatcatactcattgatatatattttatatattatatatacaatatataaattaaatacataaatattgatataaactaattataatttatatatatttattaagtataataaatataaaatataattatataaatatatgtaaatatatgaaattatatatttacatatatgtaatatttttatttgtatatataaaatctccaactaaataaaagcacataaagtgagtatttttattcatatcctcctccaaacccaatacactttcattgccaaggggcaatcactctctgtgttacatttcatacaaatacatatcatacccagattataactataacttagttttctttctttattagcttttaagtggaattgtgttagtcaagagtaatgtcagctcccaaatctcagtggcttaacaccaccaaaactcattttttgtccacataaagttctatcagcatagacaggaggatttctgctctgtatagtcattcagccactttcgtggactcaggtgacatagaatatatcaacttcagcacatagctcctgaggtccccttgggtgtcacactcaaatattcaaataccagacagggtaaagaaggtaggggaaaaaggaagcatcgaaaatcttcatacatctcattccattggttagaacttggacacatggccaaactcactgcaagggagcacaggacagtagtgtccttgtgcctagaaaagtagaaaaaagagttggtggatccagccagcttctgtgatacaaatcatgttataaaaattgctattaaacaaaactaaaatacaacaacatattttttcacattcaattgcaaaacatcttggggatcttttattttcattatacatgatgtaactcaggaattttaatgagagaagtttttactgaagatgaatcacaatgtattgtatcatttccctattgataaacatcatggttgtttcaagtttttcaagttataaatactgcagtgaatatcatcatacaaatatcttgtgaccattgtgagttcatctgaagaataaatatctagagatgtaacttattgggtcaaaaaaatgtccccagttttcattttaatatatactccataaaaactattagaaaattcagttccccaaatatttttgagtactgatttccccaatccctcactaaaattaattgtaatcttcatttaattggttatatatctggtatagaattttttacttacattttatctattttgaattgctagaatatatgcttcctcacttcttcaattgttttcatctgtcaacttataggagataatcctatataatggatgttggtccattttacatcttttcaaataagatttgttggtctttttgagcattttgtaatgttttcattgttttccctcttccattgattctgttgaaaattcacttgttaagtccagttatcagttctgtaggaaacttgtatttcctctctggatgcttttaagaagttccctttgtctttgttgaacagaacgttttcagtgtgatgtgttgagataaagaatcgtttttattcatctaggttaggttgttttacagggggcttttctatttagagaatttatggtttttatctattctgcaaatatagccctctcacattcactttatagtctcctgttaaaatatgtattatatgaaattgaattttctcattttattctccatatcctcagctccttttgcaacacctttttcaattcatagcatgttttaagatatactatcttgctcattaattctcttcacagctttgtctaacttctgtttagtatgtcgatttcaaaaatttatatatacttttactttttgaagttctatttgctaatattttattttctatctttttttaaaaattatactttaagttctagggtatatgtgcacaacgtgcaggtttattacatatgtatacatgtgccatgttggtgtgctgcacccattaacttgtcatttacattaggtatatctcctaatgctatccctcctccctccccccaccccacgacaggcccgggtgtgtgatgttacccaccctgtgtccaagtgttctcattgttcagttcctacctttgagtgagaacatgcagtgttgggttttctgtccttgtgatagtttgctcagaacgatggtttccagcttcacaatagcaaagacttggaaccaacccaaatgtccatcaatgatagactggattaagaaaatatggcacatatacaccatggaatactatgcagtcataaaaaaggatgagttcatgtctatttggtattatttttaaaactctttactcaggttgttttgtttgttttgtttttgttttttgtgggtgttttgttttgttttgttttgttttttggcagcatcttagttgcctaggtggcagtgcagtgacacaattgcagcctcaacatcctggctgggctcaagcgatcctcttacctaagcctcccaaagtactggtattacagttgtgagccactgcacctggcttatactccgtttttatggcatcctttttcttatatctactttaatcttcctctttcatttcttaaaaaataagcataactttaaaaaaattctgtatctgataatggcaacctctgatctttgcagatttaagccacttccttctttgttcagctggttcctgtctcatggtgctttttatttctcttcaaatgctttatcatttttcactgtagcctcatattctttggaactttatctgtgagaaaacttagaggcctgaggataagccattactccaaagaggatttgtgtttgctttgtccatctcttgaggaaaattccaaataggaaacattataaaataaaatcttatttaagaattttgggtctctactaaaaatacaaaaattagccgggcatggtggcgcacgcctgtagtcccagctacacgggaggctgaggcaggagaatggcgtgaacccgggaggcggagcttgcagtgagtcgagatcgcgccactgcagtccagcctgggcgacagagcgaaactccgtctcaaaaaaaaaaaaaaaaaaaaaaaaaaaagaattttgggtaaatcataataggttttgtccattaacctccatatccagctagtttattgttataaataattggggaagattttcctcctcctacatataggtgaggtatgaaagtttccttaggcatcctttttttttttccctctcttttctttcttaatttccttctttctgttttatcggctgtaagaatttttatcttggcttatagtaatttatttagagcttttttctctttgttagcatgaacgttatatatgtcttatagctggatatttttttagttgccatactacctgaaatggaagtcacagttatttttaaatcttccgtaaatttctcagaatgcatatctcctaaaggaatcttactgctttcaacactgatatatatgaatgtagcttttgaaggggtgtgtgtgtgatgtctttatgcttttgtgttttctatagattctagataaaagtaggcttagacatgtgtgtacagtttgcatagctcaatattttgtatgttgtatttgtaccatagaacacttaattgttttactataatcatctccctttctaggatttaaaaccttaaagcaacttcatttatttacttaagtaatgaacacttaccatagttctgacatctagtagttgctagagaagtattttttgactttacctttgttctaatccatagatacattctgagataaggcatttaaaaacaaaccatttttagatataaaagcaatgaacccctatgggcagtgaactctatagtatgggtccttaaatcacaaattcatattcaaatgcaaaaagtatgtagatttttgagggaatgcaggaaattaaattgaaaattatataaaaactttatttttgactaatgctatatttttacttaatggcttcattttgatttggaagtcattgaagtttgaatgccttgccattatggttagtaagaaatatataaatatgcgatattttaggactaagtgtttcatgtcaaatggaaacatttattatattaattaaatttaatttattcatttcaatatggagagataatactctggaatacttccaaattaacataaaacttacaggaaagaaaaatattctaaaatacaagccaccattaaaaatgtgtgattacttattacctggaaagtgaatccaaattagtgaaagacaagtcagtaatcaaggtgacataattaaaaatcacacaattagctctagccataagaacatatgtgctggcaaagacaaatgcaactctgtcttctgagcctcacaaggaggaaggaacttcctgaagctcataggagtctcaaagagtatctatttcgtggaaaggactcctttaaaaaatctagacctagacattaccagccaggatttgaaaaacaaaatagaccaaacgaaaagccaagtaaatcgatctaggattaattacacacaaatcattcatttacttaaccaaaaaggacttctaaattaccctctatgcaacaaaaactcacccatcaatattataaggtgaccagtaaaaccgggaccctttgaaggagaattcagttttgtagagtcgaggaaaaaaggcaattgtaatattgcataatgcattgagggtgactctatacccgtactgctctaaatgctgcatatgtactaatataatttaattctcacaagaattaaaaaaaaactaattttattttcctaaatgtacaatgagaaaacagaaaacacttaataaacagactcagggtctcaaggtaaatatttgtatggtggaaatgagtttgaactctcatagtttgagctttgaactaaaacttcctaaaatttctacactcttggtaggagacaaaagagggcctgctgatgacaggtttgaggttaagaagatatttgacattagcagagtaagaactatcaataagaacatcctcaagaggccgagtcctaaaagaccagaaggacttggctaggagaagaaggagaggcaaagaagtctgtgatgttaggaagggtactcagaaacctgccagattaagttatgtgtttaaaacctagaggaatgagacagcatgcatggagaattgcaagtgatttggtacagaagaagcttgtgtgtgtgtgtgtgtgtgtgtgtgtgtgtgtgtgtataggtgcgtcttgagagagagggctggaatatggggaggcttgtcagccatcatttaaggcaaagtgaagtcatcaatgtctcttaagcaggaaattagtaattcatgtttattttcgaaactacactctggttttagcatggaggatggcttggaaaggagctggaggcagttgaaggaggaggagaattggactgatacttgaactaagagaatgttatgggaatgtaaaaaagtaaagagatttaggagaaatacggtttgtttccaaaaggactttgtggttggttttaagtatgaggtgtgtaccagtcaggggctgtcaggaaacagacggtacattcagaaaaagtagaaatagcagatgttggcaaggatacagggaaaaggtaacttttatacactgttggtaggaaggtaaattgtacagcttctatggaaaacagtatagagatttctcaaagagctaaaaatagaattactatccaattcaacaatcctactactgggtatatgtccaaagaaaaataaatcaacatatcaaaaagatcggccgggtgcagtggctcacacctataatcccagcactttgggggaccaaggcaggcgaattgtgttgagctcaggagttcgagaccagcctgggcaacatggtgaaaccctgtctctactaaaaatacaaaaattagccaggcatggtggtgcatggctgtagtcccagctactccagaggctgagacatgagaatagcttgaatcttggaggcttggaggcagtggttgcaaccagcagagatcacgccactgcactccagcctgggctacagagtgacaccctgtctcaaaaaaaaaaaaaaaaaaaaaagatacctgcactcatatgtttatcatagcactattcacaatatcaaaaatatagaatcaacataaaggtccattaatagattattggacaaagaaaatacagtatatatagccataaagaagaataaaatcatgtcttttgcagcaacatgaaaggaactggaagccgttatcttatttgaaataagtcagacacagaaagacaaatagaacttgctctgactcataagtaagagctaaataatgtgtccacatggttgtacagagtggaatgatagacaatggagtcttggaagagtgaggaagttggaggggggtggatgatgagaaattactaaatgggtacaatgtatcttttcaagtgatggatattccaaaagccctgacttgaccactgtgcaatctatgcatataacaaaattgtgcttgtactccatacatttataataataaaaaaggaagggtaattaaaatgagtttaaggaacagactacttcaagttggaaaagtttaagagaatcaacaagagagaaatttttccagggctagaattggatagtaatcaatggacttgaagaagcaagcagatggaataatttctgcaatgtggacaaagatgtaggtataggagaagaatcacctgataagagctgtggtcctggagagaggaatgcatctaccgcaaacttgtacttaacggatagagaataaggaataaatcctctgatctttttttcttgctaccccttcaatgtccttccatcacattgcccaaacacaattggaagtcagaggcaatggggagtttgttagttgcaaccaataaaagtcagcctctcaggtacgaggcagagtagagaaaaatggagaacagacctggaagtgaggcagaaaatacctagcctggggagaaagaaaaatgtaagtgaatctcaggttttgaatttaagtaactgtgtgaacaatacaatttactgaaatggaagatacaaatttcatgctgagaaaaaattcagtccatctggttctaatagtgtatcttatagaaattcctaatattacctatccttttctccagatctgatttattattttgaccttttaaaaatatttctcaagcaatttagaaaagtggaaacttgagcacatgaacttatgtcaccacattgcctgataagtcggtaaactatactttttacaaataaacagtgatccatttaataacattcctgctcagttgggtcataaaatcacaaccctcaataccatttttcacctgggggcagctagcagaattgcacgcaaccgtggccaggggaaaataatcatttctctaaagagaaaaccttacagctattacaaatgcctactgcatcaggggaatgatttaaaagatttattttaacatattaggcttaataaaatagagccacaaatagctaaagcaatgatggaaaaattttcctttcaaaattcaaaagcatttttaaaagttagacacaatcattttacattcaaaatccaatagcttacattgaagggtaatcattggtttctgattactgtgaggaatcacaaatttaccgataaattcgtgctggatattagagaagtatgcacctaaaaaactagaatccaaatgggaaatcattacttaaaattctgttgtattagaaagaacaagcccaatcacatagggccctctattaatttccatgtgagttctaaggaaagaaccaaataatgatatatcttccattatttttagacgtgttggcatactatttttcttttatgcaaatcctggaataaaaaagaacattaaattatttgtatagtttagtcttttctacaaatacactagataatatgaggaaacacgtaagtagatcaaaaggctctgagggaaaggacagttcatagattaaagcaacactctttatctcaccttgttcattacacccaatattatactactgaagcaatggattttgccttgtctgatatgaacgtttattaatggcttgtctgtgaaaagctgggtaattggctttaaccagcagtatcctcaggacaatagagatagtctatttaccattactttttatgcagtcaaacgtgaaaccttaaaatagtctttacagtccttcagcttatctcaagacaggtagatttgtttaataagctttaaagcaactcaattgcataatctttatgtactgaacatcatatttcagagaactactagaactatttcaggtgagaatatgtggacctcagagaattatggtatagcagcattgaatagctagggttgcttctgatgtctatataagcaatcttgttttactgagtgtattaaagtaccttcaggaatgccaagggggattcacttcaaagaagaagagtgtgactctagtatactgaggcacagtacaagggagataattataaactaattattcttagttgttacttctcttctattaaataaaagcaagcagctatgtggttctcccaacgtaaaatgccatttctttttcattttctcttatttgttttactataaaaccagtattatgaccatgttttgctgaaatagtttagtgtgtttatccatttcttccctaaatattcatcgtgtgcctagtatgtgctaggtagtgagtatgcaaagattatctggtcacacaccattaagaagctcttgaagaggttaatgagacccacagacaaagtaagtgaagagaagttctaaaatgccaaaaggaagaaattaagtctgtatcaagaatttaagaaggcttcaaagagaggtcaactgatttaaatcctgaagaatagaaaggagatttcaaggtggaaaaggttattctaggctgaaaaaacagtatgtgaaaaagtgtaaaaaattctcagtactggcaactggaaaatgtaatacattttagaggatggatttagaagtcagtataaattatgatggaattgtcatttgaatatttttcaatgctagctttggaatattttgtcttacaggtgttgaaaagtcccaatttctctttagtgcttcagatgggattcatttgtacaactctgcaactccctttaaatgtaatatgggcccctgagctctcaccctctgcactctccatgccccatcctctttcattgatgccttcctatatagcccaaattcaaattagaaacctgagcgtaatcctttttcctctttctatctccacatattcattctatcaccaagatatcttcaatcattggtatatgtctgacagtccactgttgactatcaccacttcatgcctaagtgcttgtgaaaacaatccaattggcttccttgactccagtcttaatcatcctgtcaatcatcatagtcagggtgatcatgttaaaatgtaacctgttcacacaactccccttcttagaacattcagagactccctatcattcttactattaagtttaatcttcttaccatggctttcaaagccattcacaagctggttctgcctcttgaggagtctcatgtctaatctctcggccttcaaacaacttgctcttctctgctttgtcctactttccctgatggatgcttatttgtactttaattcttaacttagaagatagttgtttaagaagctttgcctgacactcctctagtacaagttagacaagtcgtatatatttaggcccctgtacttctactagaaatcttatcaccctatactgcaatagcttatttatttatatactcctcctagaatctaaactgtaacttcagtgattttatctatttcttcactcctcattgtattctgtgtgcccaatatattccctttaacagtgatggcattcaatagttgcagagtagttaaataatgtgttagagcctttaacataaaggccactgcatattacatatcatgttgagaagtttggaccttattctttatgtcaatgcttttaactatatgtgaggaagtactaaaacccataggatacacatggtttagcttctggaaatatcaatattccttgaagctaattaatatatcagttaaatagtttaaattaaaatttaatatttgtatggcttaaaataaacaacattttaataaaatattctgtgtactctgttgctagagtaaggcacaaaatactgtatttctttactcttctaagcctttaattgcacacatcagaaactcttgagaaatattgttgtagatatcagtgggttttatgtgaagtagaataataggcccagatttaaatgtaagtgtttgaaagtcacatcttctcattgtaagtgataaattggcatcatagtttacacatcagtgctttcttgtgagagcaacaaacacttgcacaattttacactactatagttatcgtcgtgggtcactgtcagcgctacaaattatttcctggtcttaagagtttctttgctgtgtccagagaccatggcaagcaccagagtttttttagctgtcacatcactaaagaagtatcaggtctgtactgacacctggccctcacatgccatcatctatgggagggatcactgcacctgtaccctgaaccagcaggacccttgcttcctctaagttaactggactgatcactgaggtgacttagtgcaggggggtttattctcaaggggacaggctttagccgttatgaatcaagggctagaactgggccataaattcatcttttcttccccccaaaagactgttctgatgtgatgggtatagggctatcttaacatgtcctgtgtggtgaagccatcagttgtgactgttatgaagttgtgatctgcttagtaatacaccccttcttatttgtcctctgtatgcactttaacccccaacttcccctcattctgggaactgtaatcaacctaagcttttaattcacattctattttctaggaaatctggtacaagaaagccagatttgggaaattggtggcagattgttgttctgctctagggaggccttaattaaacaattatttggcctttctcgtgtaataccctcttgcctcactgtacccatgtcttccccatattttctagctacaataccactctcaagaaaattttaaaacatttctcaggaggacatgttcgtttggaaaacagtctgaatgtgcatgtttggtgtcatctgtgtagttaaaaagtagcaatataacaaaaaggtgcatgctgttttcaatgtatgccactatgacagattatttcagtttgctcttccagagtcaatttctagcttgctcctgcatgaaatatgccaggaaagctgacctatcttactacatcaatggggcccctctgcgctctgtattttagactatttggcccaaagggaagtcctagcaggagctgggagggaggcaagaaaatgtgatcagaataatattcattcttgtcagtccccgtctctgaggtcacatcaagatggctgcattccttgatagaagtcacttctcctacatatccttcctcttgctttgttccctgggcccagggatggtaatagcttgtcagctgctcacctggggtttctgtactatttctgggtttccactacacctcatccactcccgtattcttgccacgtagtaaataaatcctgtttgcattattgtaacatgatgtgcatctgtttcctgtttggatcctgactaatacatctgtcaatacacttgcctttgaggaaatgaccttgcagaagcaatcaaagatttggaaatgtatgaaattacatatagaagcaaagtgaaaagaggggaaggacgaagttttgaagactattagatttaaaggaaatttgatgttaaagatgacttgacctacccagaaaacaaattttgtaatgtaagtgtaaaacttggagattactttgtgaaaaattaagcacaaaatattttgaggataaaagaatactaattgctatagaaagatggaaggaagtgaggtttgaaacacgttcacttatttttagcatttaagccatcattgttgaccatgataattgcaatttcagtagaagctgaggcaaaaaacagccagccatgaactacattatgagtaacaggtgtgaaagttcagagaaaaactgagacccagtcttgcaaaaaacttaaacatccaggggaagggtttctgaaatgattaggatactcagatcctcactagaaacttcctcaactaaaatgatgcttatccactttgtctatgagcatcatctttcttttcttcctaggtctagttttctctttgtaatggattttttaatatttctactaaaaagttatataaaatttattgtaaatatcatgagctactggcagaacaatatttagtattgtaaaattaaagttgtacaatattatttttgacaaactgtgcctttaaaaaagttcaagacattttgatttgtttctaattggattaaacagattaccatttgtatactagagaggtgttattgctgttttaattcaaatttcactttaaaaatcattactatattataagaattcaatcatatgacttaaataaccaagtgcatgtatgcaagtatatatgtgtaagtgtgtgtatgtttgtgtttgaacacacacgtattaaaacgatatattcacatgatatatgtatttgtgtgtatacataatttccttatgtacagagatagcatgtaggccactttggtagtctatttgtccattattcacatttattatgaaaaattttatgtttcctgacctcattttcttttctacaagtatctagactatgatcacatagttaaaaaaaagttcattggtcttccaaataattaaaattcatattttgtatatttccatgtgcgactgtaagagctactgattcagcaatgaatatccttttaattcttatataaaaatctgagaatcatttactataaatgacattgtctaaaatacttctctaagtatcatgaatataatcataatactcttaattttgacaaaatttacatactttagaatttaaattgagtatctgtcaatatgttaaatctactaagtttttacaaatagattcatcttgataaattttcactacatagctcttttttccttcatacatgtagaatgtatgtgatttaaatcttacatggtagtcaaatgcaaacaatggaaaagtgaacatctgctcatgcttcattgtggttgctttcaggaccttcttcatatgactgattttagatgtaggagtaagcatactaattcattagacactttgcttcagcctactaggggttcacaatggatggctatgtggaaaccacttatactgaagaggtagtgcttgatatttcatttaagcagctcctgtggatttggctactattgtctttcaacactaccagttttctttttattgctaagctgcagtgaaaaaaagacaaaggagcagaagaaaagcctctacttaatcatactgagaagttgttgacgttcatctgtcctgtggcaaagttattaaggggcctgcctgtatgatgcctatctacagaggagcacacatggccatcaatagcaaaagtagtaattagatttgtcattatgtactaccagctatgaaggagtgaaaggcagctagggaacatgacctaccatttatgagcttaacaataaatgtttcttttgatgtatatgcccacgagaggcagagagatcaagataatgagagctatgcaaatagttacatcacggataacaagaaaaaaataaatccatatctctccactggtaattcccaatgctatttctccttcattggttctccagaacttcagcacaattatttgtttcttgcaggtcatttcctttcttatatgtagtcaacacctcaaaatctattatgtctttcaataaaacacatttcttccttcaaagctaactcctgattctcattcattcagactgaaaaactttgatatatctttggctcatctttcatttctttctctactctttattctctctgccatttagaactaaatctcctgtttggactaatgaaacatttcctaactgttctcaccatctttagttttccctccaacttatacaataaagcttcgtaaatttaatttttaaaacaggcctagagttcatgatccgtctattctctgaggacttttaaatgtcactgtccacagaatttctccctttttctatttagtagttgatagttgcttgctttctttaagccatcaccctttttaccattttaatctatttatccttacttcctcttcaaaagttagtttggcctcaatatccaagctgacccaaatcccctcatctgtgtcccaaagtgcatatcatatattattagaattatctatttgtatctgtttctctttcttaactataaatataaaggcagggcctatgacttttgtatctttttatctccagtataaagtgatacacaatatcaagcaaaggtacacaattcattttagttcattggatgaaattatgtatactatgtcctttccccaacaccaaatcaagaagtgacatgtaatttaacacctggtctaacaagtatccaggaatgctcacaccgctgctctgcaatgaatggtgtggatgatgatgatgatgatgatgatgatgatgatgatgatgttggccatgacagcaaccgtgatcattattccaattttacactgtgacaacagaaaacactacaggtacattcccaagaccttacttaattgttgacaactaaaaagatcctgattacatcacatagaaaggattcagggcaaattttgagattcagtgcaagttttcacactctcacgccaccatcttcaaactggtatcaaatcttaatatggctcttgcaccacagaaaagcccattggtgttcttaggctatagaatgccatgtgatcctaagaagctatgcgtattcattccttcctccaatcaatctgctttaccttttcctacacagcagaaattaaattcaaatgttatatgtgaaagtaagcaaaaattaacttaatggtacagtatgaaataggctgcttatttcaaatttctaattttcaggagttacaagtcaattcattgtaaaaggagcttttcagacaccccaatgcaaataaacctcctgcagtagcaaagtacagagcactaaagaagctggagagtgaacccccaaggctggcctaatgagaatggcactaaaataaatcggttgctaatcagagatgaaataaataactttccatactgtttaatacaaatgcaggaaggactttgtgctatagcatgttagctcagaggataaagtgggtaaatgacaacaaacaaaagaaaaaagtgtgacccttgaatcttgggttacataaagacaaaacagattctaacagcaacagtatgccagatggaatatgacagctatcctgtttcaaagtcagcatagttatcacacaaaataaaaataatctaatagcatttacctcaagatattaagtcactgcattaaagtataaagaagaaaatgtctcagtacttctaggctgctcacattctgaacttttttaaacgtaaagttcattatcgttcctatttacgagtgtgagatcctagagcccttcctttacagttttttttccatgttatacccccatagacacctaattcaacacccaaaatgctgacacagtgacatatcaaatcagtacttttgtcagccaaatatctagatggaattcaggtagatcaatactgtgagtcatttggacttagaatttctctgtgcttaagataatactgtattacataatacataaaagtaatccttcagggcacttgccttctgagaacagaggccccatgtttgttctagctacatgaagttatctgaggcttaaccctgctttcagaagaaccacctactatggattcctctttattcaaagacctgctcttccaggtatatctagggagcaaatattgtaaccagaacttacaaaagctggggtctgggatggcgattttactattctagaattgattggtcaaccagttaccccactggctactcttgctcccagccctgttatatttgaaataaagttaggaccaaaacagctgtaatgttcccctcaacttgtctaaacatttagataggcttctttctgaatgtaggtctctgacctcccttttcttagagcatttactttataaaccttttaattggaaattatttctctgcctcttgagatgtaaatgttctcccagcctcttgccagattcacaacccaagaatatctttttcaaggatttaagagccatccctttgatatgtaatcttggaaggagatcctgcccctccgtcccagtctctgagagggcaggagcctaactttgatatgtgtgccaattagcaaacacagatggcctaatcacattgaccaacctaccccctactctctcccagtacttttacacacgcgcacacacacacacacacacacacacaatctgagttctgtgtgtgcatgttgtctcagcagaactgagttcaatttctctatcctattgcaatcgtcttgaattaaggttttcttgtatatctctggtgaaatttttctttgacagtcccctcttttgcagatatagagttatatttctaacttttattattgttttatcaaaaacaaaacttatttgccttatgtattccataattatttcaatattttatctgcctaaggtgcctgtggaagaaactgcatgcttcccttcaatattctctgattttttttccttctaaataacaggaattcctatatttattgggacatttagccatctgaagtaaagacttaatgttttacttctcttagcgttaagtatgtaaatgtgacttaagttctggccaatgaaatatgtgaagtaatatgtgaaatgctgagaagtgttctttaatggggcggggcagggggtattttttccttcatttcttttaccctgctatttgctgcaatgcagctaggattgctggagtttcgctatcttaaacacagtgagaatggcaggacatgcagttagaagcctgggttactgaccaccatgaggctgccatactagtcaggactgcttatatttacgggtgaaacaatgctattttgttttaaccgcctggttgtatttgcttgtttgttttatgtctcccacaggtggatttcatcctaactaatattggtacacccactagttttccagccttcttatcaagtagttcttatacctctttgataatggcaatgggattttagtaggaagaaagagatgcatacctttgcttagttttaaattttgtaatggaggtactgttagaattttgacaggactgatgtaaacatctatactgatgatttgaatatttattatatttaatctgccctctctattaagatttttctccatttattaaagtctttatagcaatattgtagttttcttcagacaggttttgcattatacttgtggaggttattcctaggactgttatgcttttattctatagtttaatgaattatcttttccataacatcctttatttcattactgataatatataaaataattcctttattggtatatctccattagtttaatttttaatttttaaaaaattttaacttctcttaactttccaatttgtatatctttttttagtttttagtttttaattgctgtggatacataataggtatatatatttatggggtacatgtgatgtttttatacaagtatacaatgcgtaatgatgaaatcagagtaactagagtatcactttcagcacttatcatttttttgtgttcggaatattccaattctactcttttagttattttaaaatacacaataaattattgttaactatagtcatcctattgtacaccaaatactagatcatactcattttaactgcatttttgttcccattaagcattcctatttttcccggcccgccccgaccaacccttcccaattgggaaaacactccaggacattggtctgggcaaagatttcttgagtaagacctgaaaagcacagacaaccaaagcaatgatggacaaatgagataacaccaagctaaaaagcttctgcatatcaaaggaaacaatcacaaagtgagattgagaatgttaggttgattttttaatactgttagagttttggttgatatatttaatctaagatatagacacgtaaataaaaactttactttgtatttattttaccattaacatcttatttatgtttttgtcttattttattgtccagaacttgcacataaatggtaaatagtaacgaaaagttttctccttatgtctcagtagcacttatttcatgttttattaacatgtaatcaatgaccatgatgttctcttctctgttaacttaaaatgagatcttaatcatttattattattcaagtactgtttttctaggacatttaactcaaaggagttttcatggtatgaactacattgttttggcatatattgagatgttgctatctgttatacttttcttattgggcctactaatgggatatatacctaatattaggttattttgttttttttttttctttttctggagtgtagttgcatcttggctaaccacaaccaccacttcccagggtcaagggctcctcccacctcttcctcctgagtagctgggactacaggtgtgcaccacacgcatggctaattttcatatattttgtagagaaggttttttgccatgctgcctgggcttgtctcaacctctgagctcaagcaatttgctcgccttggactccaaaagtgctgggattacaggcaggagccactgtgccaggctactgtattcttgattacttgtataagtcccatttagatgagataaaattgtaaatgtaattatgatctaagtttcctaacaatgtgcccatgacatgtgcatttatttcagaagtgattttgtcatataacacttcttcctttataatataagcaattttagtgctttctaccaccctatcccaacacaaacacagaggagactaatttcatttgctagttttggtaaacattatctgagttttagaatcctaaatattattcaatatttttatattgtatatatttaatttcagattattttttgtaatttgcaaaaaatacaaattgcataatttgtatttttataattatatatgtactgtattttatgttaaaatggttcattattagcactactcctttaaaaatcacaagttcttcattcttagttgatggcacacgttccctacgttatatgaatagtatgctttttaagactctatttctatatcatcaatatctaagtaaaaatttgacagatattttttaaacattccctcccactcaaccccctggtgagcttcctttttgctttgctggcttttctttggctgtttaatgttggagagaaacatcttaaggcatatactatttttgttatcttaaaggtaagctcttttagtttcgttttcttttattttgtttcctgcttgagttcttacagccatctaaaacttatttttcaataggaacaatttttccaagacttacccagtatgtctctcttttcattaactttgcaagaatctggtgaattcttttgttaggtttacacaagccttcatttcaacaccagaaagttttctttttaatgtctttattcttcaggaaaaagggagcaacattattacactggtgctaaaagcatgatttttggagtcagactattttgtttaaattctagcttaattatttataattctgcaggctatggaagctttcatgacctctccttgcctcagttttctgtgtgtaaggtgatgatagtaaacgctagtgcaaatgacataagattgttacaaggataaagaagtaatctgtattattaaaaaagaatctggcacaggataattgctcaataaatgttaactgttataatctcctcactgtcatctctcttatttctttttcctctttattctggggacgcttctgaaagtttttctcttctgatttgattttctcaagtcactagctttcttcagtaaatccaatgtgtattttactcaaacttctgcgatattagttttattgaaatcttttcttatcttacctagatcccttttcatctaagcttgttggttttatatctcatcttcttattcttttaagccagactgttctttccttatgacagcattgtcctatttaataactttttgaatttgatttaatatggaattttcccgcggatctacagtaaactacattttagaggtgctctttctctttcaagatgatgtgttttctcttctgccttagtattgtttcatgaaagccatattgtcactgttgtttttaatttatcaatattcatttcccaataaaggaagtcatggctataataagtattcctaaccaacaggatatggcgatttctcttggctctgacgattggctgaaacccatatggatgtataggtttgtaaaacagacccttattaaatgtagatccagaaggtagtgtgatacctaaagttatcgacccaaaaattaggatctaaaaactgttctgtttttgtggctccatgaaaaacaaagcaacatcttctctcaataaaagaacaagataaagcctgcagcttcaaatatgcaaagttatgcaataatctttctgtctttgccattagcaagtgctttaatatgtaggactatatttacaaaggcagattttatccttatattccacacccatgtatttacatgttgcatagctaaagcttaatcttctctattggtatagatattttagatggaatattcaatactctagtgagctaaaagaaaaacaacaacaaaacaatgaatgcctgtatggtaatgggaaggctgcttagttttcaggttcaaatagaaacttaggaccatgtactagctaatagtgatttattagttagctaatgccatgtcaaacccctccaaaacaccacacttttacttaactcacaattcggcaggttgctaatctggactaggcttaggcgggcagttcttctttgttcacctaggcttaatcaggtttcctctgacaactgctgcttctgttgggatccaaatgatctaacttggtctcagttaggactactgatttctgttccacaagttatctctgtcctgcaggctagccagtgcttgtttacagaatagtcacaggggattcaggagagcagtagaagtgtgtaatacctcttgagattcgagcttggaagtggcaccatgtcatttctgctgaataatggcaaaagtaaatcacaaagccccagagtcaaggtgtgagataatagacttcacttcttaatgaaaagagtgactggctgggcgtggtggctcatgcctgtaatcccagcactttgggaggctgaagcaggtatatcacttgagtttaggagtttgagaccagcctggacaacaaggtgaaaccccatctctactaaaaatacaaaaattttccgggtgtgggctcctctattctcgtctattcaagaggctgaggcagaagaatctcttgaacctcggaagctgaggttgcaatgagccaaggtcgtgccactgtactacagcttgggtgaaagagtgagactgtctcaaaaaacaaaaaagaaaagagctgctaagtcacattgtcaacggcatggatataggaagaggttacggattgaggatattttacacccaatctgtcagtggagaagccataaaatgttttctaacattttattggaataaaacaaaattatctatttttctcattcagttttgtcattctgagagttatgtttacccccaaaatttaaggcacagattattgatgttactttttcttattttttattacctccgaaaatgtaaatggtttatgtcaaagattgataacagtatgcaatttaaagtcacaaaaaatgccaatatgcattttgtagaagaattatttctttccattgtattgatagtttgctgtaaaagttacagtttttgacaataaattgaaagcttgaaagaaaagactaataatatgttgacacaactgctaggtataggctggtccaacattggatctgtaggaattgatcacaataaactctgattggtgaaagctgtatgaaatgtcttagcctgatgctaaattatcttgactttgaatgaagtttcttgaactcctcctggtcctgaactggaaattttcatgatgtctaacgtctagagaagaattgctagaatatgttgtggtctcatcatcttttaacaaaccagttttgaacaggtagtgatcagaaattgagaatagaaaagtaaaattgaccaaagaatatatctcagaaactcaaagtagaaaggacaagtatgttgaccttagtcacatctgagtacttctcattaccaattgtgacttttggcaagttaattgacaaccaattccagatttgaaaatgctgtcctgagtattaatgagatttttatatcaggtgcttagtacaatgtctggatcatagtatgtattttccaaaaaataactcttcttatttagagcattgccttgattaggacttcctggagttagcacagtgaattataaaattatgaccatatctttgctctaggttttttgcctccatattccgtgttagttgttttaatcattcagtccaacagttaagagtggcaatacttttcagattcaggtactcacagaagttttttcaaataaaaattgacatgaaaatttacattttcacaagaactgaaaatgtctaattttttaagtgtttatatattaagaagagaatcaagagggagttgctattacaaagagttaataaaactctaagacaatcagcttgcattatgtatttcagtttctaattttacttcacaaaattataagtgtacaacacccagacactaaatactcaattaatttattagtgattgggtgttttaattaagatgattaagttttagtttggtattaatacatgggtaatacctaagcaataatgattaaagtttgagtgagaggttagtgaaattcctgtgggaaagcaaaacaatagagtgcttagcttaaaaaaaaatccccaaaactaaaaaaacccgagtgagtaatgtttaccagtcagcaaaagtgtaacaaaaattatattcctcagggtgaaactgtcttcagttcagtgagtttacagttccattattacaaaccacttttaaaatgagtgttattgaactgatgctgatttaagaccttatataccaattttggtttaacaacaacaacaaaaaagacaagtcagttaaggacaaaatttgaggcaatgtcacagtgacacttcactttcatggaggttagatttatggcaacctcactcatccagaacacagctctaatgaaggcttggtgaagcaagcctctgtatggccacgtgtctctgaggagtcaccagcattactctctaggggacatgggctaaccctaagttcttaaccaggcactggggtgtttggtaagactccaccaaattagacacagtgcaataggctgacagtagcaaaagaagttagaagggttagaaacataaagccactgcaaatagtgagcactaaagctatcataaaaatacctgatgttttgaagaaagcacttgcttatgggctatgtattctatttaaaaaagcaagaaaatatgaaaacagtcacattgtgcatgctttaaatattcaactttcaaaataatgatttagaatatacttttggggtaactgaaaaaatgttgttttacatatgtaggacttttaatttttgaagaatctaaagatatttagtcaagcaaactttttgtatgcttccatgaaatttatttatcctaacttttttggaggggaaatgttgcatgaaattaacaccacaacccaatgctcaaagagatctgagaggctcgaatgggactgctattcagtggagccagtgtcataaagaaaagtagttaaagacttcttcctcaaacaccaagtcctgacatgggctctgtgcctcttctatttgctctgttatctctttcccttcttactaactctcccacccatacttcacctctcttcctagccatgtgttctgtctgctgtgggcaatttcttttccattatccgtgatagctccctgtaatgaagcttcattcttcctgctagcatccccactaaatgcaccctaacagcaaaatgaattccactggctttaaagacctaaatataagaaatacaataaaatcataatggcacagaaagaccatatagacattaaaaatcttgaaacagaagaaaacttgaaactagtaacaaaatcagaagctaaagaactaataaatttgactaaataaaaactttaatttctgttttgaacatttatgacagagggaatcaatataaattaaccaaaaagccaatgaaaaaataaccaaaggtcagaacacagaaaaggaatatggatatgttacaaacaaaagattgctcatccctactccaaatttaaatattttcatgttttacgtatctggcaaaattttaaaaaatgattatggtgaggttttaggtttttgctctcttatgttgtagatggtgataggaattgaactgacaccctttttttgaaatttggttaattgccaatattgattttgtgtttaaaagcatatatctttccacttttgaaagtttatcctgcagatacacttgcatatatattcaaatatatagtgggtgatattttaatcacagcatttttttttcctagcacacaactgcaaccaacaaatccatcatcataggaatgtaaacaaattatgtcacatccataaaattaaatatcatgtagctgttaaaaagagagaagtagatttttgtgtactgatatgaaaagtctccagtaattattgttaaaaaagaacatcaaagaacacactgttcatggcatcttctgatttaggaaaacaagaggctatatatataaataagtgtatatatgaatagacaacattaggaagggtatataagaaataattttggggaatagagatagagttctgaggtgggagagagaatcacttctaatgtgtagtcttttgggtaattaaaatgatttacatatatgatttacataataatgaaagaacaatataaagactatcctgattgctatgtagacaacacatttgaggaggtgtaatagaagggagaccagttggggggccattgcagtatcccaagtactgatgatgttatagcagctagggagataatggaagtgaagaagatgaatatgctggaagtatatattaatgttacaatacatagcacttgctgatagatagaattttggtgactaggatgcaaggaattaagaattgtttggggattctgacctgagcaattgaatacataatggtgctatttacaaaaatgagatgagtatgggagggggcagtgttataggagaagcttagacaatcccacctgaggaggttgtatttggagatttgccatggtttagctcttctttctctttggaagagagaattgataaatgctgttcattgccctagcaggggataccgcaggcattgacaacactttgcaaaagataatttatatctgaattaacaaaacaagaaaatgagagcattctacagtactaatatatcttccactggctgaaaaaatgtatgcttcctcatgtgtgatgtttctattagagaatcagtaatttttctcagtgctttcaaagagagcaaaaggttctaattgattcatcattgtctaccaactaggctatgacagggcaatggcatcagggtcaggaatagtttctctttgaagcaggtaccagcttattacagagcttggccaaggaaaccacactatactttgcccatctaagatggaatagattaatcttataagggacaattaaaatgaaacaaaataccataagaatttggggctgaaaaatcagtgcgactaacatagaataatttcatagaatgaaataaaaatggaaaataaaaataatttgttgaaaaatcctggagtgattaatgctacatcacttcattgctttaaagtaatcaatcttttttttaatctctagaagggaaaagatagttatccctctaggtaatctttgaaagatacctaaaaccaaccaaccgactatttcacaaacaaaccaaaaaaatagaaagtgttctaattgtaattatatttctgttaataataagcatcctagtgaaggtgtcaggttagcaaattgatacattagatgtatacatatacttgatatacatatattgtcagtcaaatgatttttaggataccacattattttccttaatttttgacactactatatttcttgctatttgaaattctgaaattgcattgtttttaatctttaaattatatggttacctctaaaaggtctctgtgatatttttatatttttaatactgctaactctttaatacattcaaaagtatatatatgcaagatatgagcaaggtattatctttaggacatattacaacaaacatattttgactttgtagtaaaaaaaaggacaattcctattttttaaaaagctctgttataattctttacaaaggtccaaaagaaaacatactttactgaatatcaacatactttaagtaaattttttcttagacaattaatttaacattctatttatgtagttggttggataattggataatggctgaaaaacacaaaatgcagccttagtatttatcgtaattctggcgtagacatatttttacaattttattttcaattcaaccatttttaaaatgaataatggtgctatttatatgcactactctgtttttggttcactgcagcaaagtatctacttctcattttagtgtagttgtgaattttcttcaagatgactttcacatgtgtcatcacatgtgtcatggtgtatatacttatatactcaactttttctgaaatacagtaccaatcagtactaggtaagaagataatgatgaagattgccgggggtggggggaatgggcaatttctccttctgcagacctagcagttaaagatttatttggggtattgagaggtgaacgaaagcacctacgtctaatctaactacacattattaaaaattaaaagtggagaaatcaacacaatgaaattcacataattgctgatacttaatgaaaatgaaagatttatatgcgctgatatataaagctaagatattgaaaaaccaagtgacagattgatatgtgagggattatagaacttgtaatagctgataaagaatatatttgttaagcatatgcaacatttgtttaacttttaaagcataataataaaacaatgagtctaatgacttaataaacagaacatcagtagcactggtttagtctcttcagccccagtcctctgcctcacactcctcaacaaagcattccctatttttgaatttcagtttgctttcctttatatcttttgttttgatccccaactgaaacagcatagttgttaattttatttgtgtttataacttataaaaaatggtgtatgtacactgtattattcatttatgacttccttattttcaattaacaacattcctaagatttaaccatgttgatatgtttatctctaggtcgctcagttgaattactctataatattgtgttaacatactacttttctttaccagtgtgaacagaaaatagagttgtttcagtttttagcagttatgaacaattactttataaacattcttctgcatatttcctggtggctaagtacaagagcaagaagtaaaatttccaggtatataagatactgttactctttattcttatcaacacttcttattgttaagtttcaacatttttgcccatctagtatttaacaggctttattgtggcttcagtttgtgtttttcatacacagccaatttttctattgagttgtcctacacatttgtatctgatttttgtattatctgggaaataatcatttgtcatttttgtatgttacaaatatgtcctaccaattgtggcttgtttttcaatatgctttaaaaggtttttttgggaaacagacattctcatttgtagcataattaaatttactgattttaaaaatttatgttaaagatttagggtttcttttattatgaagttatagagagagcctcttatatgttctttggaaaatttaaatgtttccttttctttttgtgaagtcagagaaagagtgtcatatgtattctctaaactttaaaactttacctttttaaattgctaacttaattcaattgaaattgatttttgtttggtgggatcaaattttgtattttgtgggttttttttgcattaaactaaacactttatccacctcattttgtaaatcatgtatgtccgtctgttgttccattgttctgtttctattcctgtgctgatactaaatattccctattcttattttattttatttatttatttttttgagacagagtctcactgcaactcccacgctggagtgcaatggcgtgatctcagctcactgcaacctctgtgtcctggtttcaagcgattctcctgcctcagcctcccgagtagctgggattacaggcatgcgccatcatgcctggataataggccctcacacctggcctatatattccctattactttaagttttgtaatatattttattatctaggaaggcaattcactctactagttttgttttgctttgttttgttttttcttctccaaaagatatagaaacccatagggattttgagcctacgtgtgtctttgcacatgaggtgggtctcctgaatacagcataccaatgggtcttgactctatacaatttgccagtctgtgtcttttaattggggcatttagcctgtttacatttaaggttattttgttatgtgtgaatttggtcctgtcattatgatgctagctggttattttgcctgttagttgatgtagtttcttcatagtgttgatggtctttacaatttggtatgtttttgcagtggctggtactagtttttcctttccaaatttagtgcttccttcaggagctcttgtaagtcagcctggtggtgacaaaatctctcagcatttgcttgtctgtaatggattttatttctccttcacttatgaagcttagtttggctggatatgtaattctgggttgaaaattcttttctttaagaatgtcgaatattggcccccactctcttctgacttgtagggtttctgcagagagatccactgttagtctgatgtgcttcctttagggattttgactggaattgtattaaatatatatgtaatcatatgtgtattaatattatgtacaagtaaagtagggtagaataaacagcttaatagtataaatctccttattcaagatatcaatttaagtcttttaaatatatttcaataaggttttataatcttacacatgttgtatttttatactcatttataggtatcttgcatatttataaattatattttctaaaactttggtattaatatgtagaaatgcaatttgttttcacatattgattttcaccagactaaaatatcttattcattcccttaatgtttttgtattttcttttcggttttctatgagggtaatctatgaattttgtttttcttctaagcaaatctacaaaacttccattaatttattttatcttactgcactaactagaaagttcattaccatgatgaatggaagtggtaaaaagcttaacatttctcagttgcttactatgtgtctctttattctgctttttgcacatcaggtcccttctgctcctagtttgctaaatctttgtatcatgattagatgttaaattttattgaatgtctttagtatttattgagacggtcacacatgttaagttttaatttaagtttaatttctattttctgatcgacttctttattttgcataaagtccatttttcctttaacgtcattgttggttaaagtaatcatctgcaatctaatctttcttgggataaatctgtcctcagtgtttttttccccacctttttttctaaaattctttttaactaactatatagtctctatgtttttccctttatggagtgtttgtataggctcatgtatttttttaattcatcaattttgtaagctcataattcttttgaggactactatcctaagttaagtggacatactttccttacagctccttcttcctcttgttcatgggcacctttcatttctttccttaaatactaatagtctcacagatactagattatatttcagtgcattaccagtcctcttaatctagctgggtaggctgagctgtggtcatggttatttgcagcttggaaactctacttgcatgctttctatttttgtgcagtttgagaagtcccttttcctcatggcaaagtgactttattttcttccttccaactacaaccatgtttgcatgttaagttattaaaccttcaagtctttctggctttttggttaagtgtatttccttgtatgtagacacttgttgccatttggtaggatttcaggtactggctgcctccagactcctttctgttctcacaactaactcttgctcccagacttatccctccggatcacgtttctgcttatgacccagtgatttagagtaaatgtgcatcaagaaattgtttcccagatcccagcgtataacctttaagtgacggtccacaggtattcactttcaggtctatacgctatggccctgcttacttaatctgctctactccctccattcatttattcattcattcatagacagggtttcactccccttgacctgcctgagtgcagtagtgtgatctcagctcactgcaacctgtgtctcctgggtcaagccattcttctgcatcagcttccggagtaggtgggaatacaggcccgcgccaccacgccgggctaatttttctgtttagtagagacgggtttcgtcattttgcccaggctggtctcaaactcctgggcccaagcaatctgtctgctgtctgcctctcagcctcccacagtgctgggattacaggcgcgagccaccacgcctggccgttttttttttttttttttttttacaaatcagctacattgatcttagtgaccttcgaatttgccaagtatgatcacattaagaattttgtacaaatttttctttcatcctggagtggggtaactatccttcttttcttcagtcagatgtcagcccagaattccagtttaaagaaaaactttgctgaccattctatttaaagccttaatccctgtcactcctacttatattgtgacattagtacggtgtctttgttatgtttgagttgtctacaagtaccgaacttagactcattgagaatgacagcctgatcatgttcattgttgtatccatggagctaagcacagtgcctggccatcgtaagtgttcaatccctatttgttgactgaataaatgaaaaaaaaaaagtttgaatgcctagtggcgactatctggcagctggaagctggaacaacaatgccacaaagagctctgaacgtgatttcagctgttttcttcaagttctgtatctctagcctgctattgatcttccagaacatcccataaagcatgcacctggcaacctggtcacacctacaaccttcagccctccaaattggtgactggtaatgggatttttcacaactctctgttgatttcactcaaatctatattgctctgggggaaaagcagaaatatctgtaaacaggaagcgtcctcttttggtttagtccaaattaaatctgcatatattctttgaaataagtttgcgattggtgctaacccgtctttcaagttctgatagggttgtctttttaatattgtgcttatttgcatttaatctgaaatggctgggtggtggagtatgcataagtctgtacttaaagacatatataatataattgggagaaactttcaacctctattctagattatctgtattttgatagaatcagaaccaattacaaatgcacacttatcatgttctatttctttttttttttttcttgagacggagtctcgctctgtcacccaggcagtggtgtgatccgggttcacgccattctcctgcctcagcttcccaagtagttgggactatgtgcgcctgccaccacgcccggctaattttttgtattttcagtagagacatggtttcaccgtgttagccaggatggtctctatctcctgaactcgtgatctgtgtgccttattacctggccaggcgcggtggctcacccctgtaatcccatcactttgggaggccgaggcgggcggatcacgaggtcagagattgagaccatcctgactaacacggtgaaaccctgtgtctactaaaaaaataaaataaaataaaaaaatagctgggcgtggtggcgggcacctatagtcccagctacttgggaggttgaggcaggagaattgcttgactccagggggcagaggtagcagtgagctgagatcgcacctttgcacttcagcctggatgacagagcgagactccatctcaaaaaaaaaaaaagcttattgccttaagagatacattccaatcacactactgttatagcttcttatctctctaatacagcattgccctgaaaatgcctatacatccctgagataatcaggatataggtattttctttccttctgaatattttaaggtttggtctttagataccccttgaacttgttttgtgttgacttcgagattgacagtttgattactaggctgaagatctgttattggctaagtgctaagtttctagaaataactaagcactcaaccaatataattttgtacccttgaaagataccttctataattaggtataagtcaactgtattcttcaaaagtcatccttcctctttgctatcttccaaaataaatgggttaaaattagaaaatctgtttacattttcttcatctctgtccatcaattccaatgagttccatcatagttcaaatttaatctatgcataaacacttaatctaaatcatgtaataattctaattatcaaatctagaatcaatgagggatactgctactctgaacttaaattggagtcatgaggaagaagaatttactgaacaggaaattgtagaatattcagagactgaacaagccacactattgttctaatatcaataaaaggaaagacggtaatgctagacatgtaacaaggctttcaaaaagtcagtaatggtgaaagcatatgtgtgattatatgcagtattcaaggtcctgaaatactgaaataaaattggttcatgaaaaataatacttccttgccatagaaaataggaagtcagatacactcctctatgataatgtaattttattgtcaaaacctagacatggcctcattagtctaggttcatttctattattgtcacaagagtggattaacatcagctagtctcaaaatagaattaatttggaatatattctgcaaaatgtcaaaaagttatataaatcaagccaaaaaatttagtgctcatgaaaatatatgacagctaatttattgatgcagtttttctcaggatctgtgtaaatcaaaacaatatattctatggtagcatttttgaaatcattctatgaccatggctgtcacctattaatacatagaatacatagaaattctccaaattcatcttgtccacagatagagcattgagaacttgttaaaatcattcacgtattgaacaaaacacaaactctctcctaatgcttgtcccccaaataaaaataatgtgatttttacagatagctttgtgaaacacagttgcaatttccacaggtgtattgaacacatcatcctcaacaaatttgtagcattatatatatgaacatatagtggtatccaaagacagtctgataacccagtttcaaataattccaatgagaaaattaatttggctttacaaagaagtactcattatcaaggccacccatgctaatgttacctaaacctgtaagataaacctaaacctgtaagataaaagcacagaaagaactgagatttataaaactatccatagcgcaggagactttattttctacatttagtgaaagaagaaagaagtaaaaggactggccctagtcattgggcagataagataatgtccatagaatccagaaagaaagtataattatacaactcttacctttcaaggagaacgagttgcaaaatggaaagtttatcttgtacaccataaagtagaattgaagtatcaaatatatctcaaggaactgaaacaacatgcagatgtaaataactaaaaatttgaataatcaaggaggatggagaaacaaagtgtttggataggctcaaaaattctaatgcaatcctaggctaaaattctgagcaaatagcatctagtctaatccatacttttaagatcacatttgaaaaagtttggttctgggctaaaactaaatactaaatgatgaaatatatcaagtctagagaaagagtatgaaacattcagaaatcatataatttaaaatagaaactattgaaatttgacttgaaaatatttagtaaaggcctaattatcttttagaaatcttaagaggggcatgtagaaggtaattatactatgtcaaagaagctgtagtgggagagttcagcattatagctcttacagcagttgaaaatgtaattggatgccttatgagatagtaaattccactatctcaagtctttaaacagaacctgaatgaccacctgtcaaagatatcttaaagaacatttctgaattaagcagaaagtttatgtaactgctaaatgttcctttaattaatgaatatcatttgcagcatctttattatctttggaataaaatatcaagatcatatattaataatatgttttctaatcacatttttagaagctttttaataatgaaattattcattcttattaagaaaaatgtactttataatgtctgacatatatgacaatgatcattctgcctttttatttcatgtaacagaattttggagttgtaaattcttgagatattcttattttaataagaaacttctttgggtccaatccaaggaaaaaattaaactgtttactgtaattaggaaccctaaaaacacactactaaaatatttcactgcctaaaagttcaaatttttcttgataatttgggataccaaaaggtcatgccctggttgcttaaaaacatagaaataatgcccagtttttaacattgttagaaggattagtctagtttggtcagccaaaaactctctctctctctctctctctttctctctttctctctgtctctcctccctctcctctctttctgagatagggtctcgctctgtcattcaggctggagtgctgtgaaatgatcatagcttactgtaacctcgaactcctgggctccagcaaatctcctgccttagactcctgctacaggcacatgccaccatgcctggctaatttttttcattttctgtagaggtgaggacttgttatgttgcccaggttggtctcaaattcctgggctcttgcaatcctcccaactcaaccaaaatctttactaatacattttcactactacaaaaacatgctgccatcttccaaccctttttgtttgccttttaattttcctgttaacttacacataaaacttcatatttgtttttgcttttggtagaataaaaaattaaaaagtacttatgatttcttatacattgaatagcttttgctttaaataaatacagtaaaagaaacattaataacttgagatgattttatgaaaaagcctgctgtttttactcagcaaaaagaatatttgtaatatatacattgtggattcccaaagggacaggtagcattttaacacaagaatgaagcttacatcagcctgaagccaaaacaaatggatctccttttttatttttattttttgtaacagaaaatttatagtcagggttgaggaataaaggccatgaccacattcctgtttactgtagctacttcccatacctctctagagacctttctatccacttgtaagggtaaggtgaaaatgatggctgttgccttaggaaagacagcagggacatggctctcagcttcatttcctacgtcttggaagtatctgacttccagatatgcattactgtattaacacgcaggtcttggaggaatggatagtttatttttccagctaaattttatccttaggcggaggaatactaacgagaagtatttatgtcctgtagtatattcaaattactgtctcccaccacacagagaagcagcctgttgttcctttttctcttttgtccttttgtctcttttctttcttctcttcattcttgatttctctacaatctaagcagcttgtactcctataccaaggcctgcagaatcacatattttagattacagttcacgtttcaacaactgtatcaaattaaataattaagactgacttggcctggatttaatcccttccttgctttggttctttatttctttggtgctccagaaactagggcatgattcactggacacggcagtatgcagagaaagaaaagattgtcaattgttgcccattatgtcatgtttttagtctagaagttatacaaatcacactgttgctctctcacgtataaattacagttattctaaatgacataactgttggtagaaatgtaagcatgtattcttaaataaaaatatcaagtaaataaattaggaatgtatatgtcattatagataaaaataaatgtattatctagtgtaaccctggcatttgcatttttagttatcgatcatcctgtgaacaaatacactgctttggtttcatcatgaaaaagattgtgtgactgcaggcaggtgacttaacctcacctagataagaaaagagtatgttagtagatgatctctgaggtattttccagctcaaaaattctattattcttatgatttctagactatgcaaatactatacatgtgcttaaggccgtttgagtcaaacttgtagatgtgtgacttcattcataactgcaaatgaagaaaaatctaaatcacgtgctaaagaaaaactccaccataaatttatacagatggttctatttgtgtacaacaccgtataaaataggtctagggaaaggcatttaaagtaaaataaaaccctgtgaatatgaatctctagttatcattgcattattctctagattgcaagaaatggagcctgtgaactttaatcactccttttgtaattctaatcaaataaaacagctagaaaatgccaattggtaaagtcatctagctccagggggcactgctgtactgtgcatcaggtttggtttattgatgaaggcttaagcaagatttcattaaggagttctgcaggtttcagatgcagaaaaagcacataaactatttataatcaatttaaactttgagaaaattaggtaactatgtaaaatatttatatgcagttttttggaaatgaatgtttcctttgttggtaaaagtatctgtctttctgcagcaactaactatggttgtggataggaatatttttattaacttttccagtcaagggctcatgaaggacaatgtatgtttctgctatggaattatttaaagcattctgccctaatattcaaaatataaacaaaaattgatatacttaatgcctggacactgcaatcctttaattggctttaccattgttatagtcagttaatctctgatcagaagggttttgtataattatgtaaattctatctatgacttaatgcatctttcaaaaaaatctcaaatatagcagctcaaaataatctcaaaagtgagtgaccacttgtatcttattaaactgtgagaaatgagtagtgctaaggtgagagtcaagtatggaagtcaaaatcagcactctcatatgttttaaaagcatagtaaaagaaatactttcgaaatgaattgcatcatttaaactattatatgtggattatgaatacctaacaaatctgtaaatttaattaaagaccaaatcaggataggcaagtatttatagtaaagactgacagaattttttaaatttatgttcaagtttagctcaattatccctcactattaaagcactgataaacattgacttgacattttcaaaccaaacacaggtgactttcaatggctgaaaatcttttaagcaaagaattgaaattctatttagattagggtaatgtctggtcatttctagtccacacatcataaaaggcataatgaaccaccataaaaatcatctggatttttcatattaattattgtgcatatatggcatgattttcaatgtaaatgacttgttttagcagcaatgtattaatagaagaaggaagagattcaggggagcaaatatagaaagtaagaagattggagggttttttgcaataatcctgaactaaggcactggccttgaatatggagtagaggggaaatttttgagatatttttaggagataaaattgatgtaacttactgactgcataaagggcagagtggtgagagaatgcattgactgtgattatatgtgatggtggaggctctaactgaaagtgtctattctgatgtctgggcagacacacaaacaagcacttctgaaaagcaacagcaagcaatatgaaataaaaacatggaatcatcatataaattggcttatcaatttattttaattagccagtagaaggacaacttgagattggatttgttcaactatatatcttgattctggggataataaactaataatcattcttagttgcaaagattttgggacagggtctaacatagatatccatgcaacaattctacaataagttctcttttctttgtctgatgcttccaaattagagtcaaccttttgcgtattcttacagaagtccaacacttgaaggaaagtgaaaacaaagccctatcaggagtgaaatataatccaatcatttaattctcagaattggtattagttctaatctaacaaagcaacttagaatcaacttagaatcaatctctggatatgtcagtgaatgtgtctttagatgactccagctgccaggctttaagtcttccagctgaggtttttcctaaacattctgggagagaaacaagctattcttgtgtcctcttggaatttctgatccacagatttcttaagcataattattgtttcacaccagtcccattttagggcaattttttggtaaaccataataactggaatagcaccctaggtcaagacactgctatcttatgcctgaactactgagagaaaatgttctttcaacttactccactagcattcaatcctctgaaagtctattgcttctgcattcaaaagatactatgaatctgatgaattctcattgtttcatgtttatgaaaactatttcctgaacttcagttctgtctcttatagtttaccagatggcagacagaatcacatatatttaacatatatattacatcatgtcttgtcactgctcaaaactctgtttcccagtcatactgaaattgaaatttaaaatctttaatgtggctataaatttcctaggaagctttctgatctaatattctactacatcttccatgtccacttcagctccagtgatagtgttacaggaatatacaatcttcattttcacgtgaatacttttatgttatctggtttctttgcctgaaatattcccccaaatattgtcctggtcaagtcctcatatgattcatatttttttaaagcaccacttcttcagagatgcctttcttgttctgcctaactaacatagttaattaggcaggtcagaatcaatatgctctgattccttactttgcctttcatgtatcccttaactctagaagttagactatataattattaatttattagtttgtagcctgtcttctatactaacatattagctctgtgatggcaaagattttagttagttcacactgtattctcaaagcttagaacatgactgaacacatatggggtactctgaagtattctagaataaatgattagatgactgactgaataaataaatgataaacatgcctagtgagaggtgaacacacgcttttcatctctagtctattagaagtaactcacaagctggagggaaatcctagttctatcttataacaggggtatgcttttggatatgcttctgtattagtccgttttcatgctgctgataaagacatatctgagactgggaagagaaggaggttttattggatttacagttccacatggctggggaggcctcagaatcatggtgggaagtgaaaggcacttcttacatggtggtggcaagagaaaataaggaagatgcacaagcagaaacccctgataaacccatcagatctcatgagacttattcactaccacaagaacagcatggggggaaccgcctccacgattcaaattatccccaccaagtccctcccacaataggtgggaatgatgggagtacaattcaagatcagatttggatgaggacacagagccaaaccatatcattccacccctggcccctccaaatatcatgtctttacatttcaaaaccaatcatgccttcccaacagtcccccaaagtgttaactcatttcaacattaacccaaaagtccacagtcgaaagtctcatctgagataaggcaattcccttccacttatgagcctgtaaaatcaaaagcaagtaagttacttcctaggttcaatgggggtacaggtactgggtaaatacagccattccaaacaggataaattggctaaaacaaatgggttacagggcctatgcaagtccaaagtccagcaggacagtcaaattttaaagctcccaaatgatctctttgactccaggtctcacatccaggtcatgctgatataagaggtgggttcacagtcttgggcagctctgcccttgtggctttgcaaggtacagcctccctcccagttgctttcatgggctggtgttgaatgtctgtggctgtaagctgtggtaggtggatctaccattctggggtctggaggatgacggccctctttccacagctctactaggttgtgccccagtagggactctgtgtgggggctccaaccccacatttcccttcttcattgccctagcagaggttctcgatgagagccccacctctgcagcaaacttctgcctgggcatccaggcatttccatacatcttctgaaatctaggcagaggttcccaaaccccaattcttgacttttctgcacccgcatgctcaacacaacctggaagctgccaagacttgaggcttgcaccctctgaaaccatggcccaagctctgtgttggcctctttcagccatggctgaagcagaagggatgcagggcaacaagtccctagactgcacacagcatggctaccctgggacctgcccacaaaaccattttttcctattagacctctgggcctgtgatgggagaggctgctgcaaagatctctgacatgtcctggagataccttccccattgtcttggagattaacattcagctccttgtcacttatgcaaatacctgcagccagcttgaatttctcctctgaaaatgggattttattttctatcccattgtcatggtgcaaagtttgtgaacttttatgctctgcttcccttttaaaactgaattcctttaacaacaccaaaatcacctcttgaatgctttatcacttagaaatttcttccaaatcacctcttgaatgctttaccacttagaaatttcttccaaatcacctcttgaatgctttaccacttagaaatttcttccaccagataccctaaatcatctctctcaagttcaaagttccacaaatctctagggcaggggcaaaatgccgccagtctctttgataaaacataacaagagttacctttgcttcagttcccaacaagttcctcatctccatctgagaccacctcagccttgatttcactgtccatatcattatcagtatttttgtcaaagccattcaagtgtctaggaagttccaaactttcccacattttcctatgttcttctgagccctccaaagttgcttccacatttgggtatcttttcagcagcaccctactctactggtaccaatttactgtattagtccattttcacactattaataaaaacatacctgatactgggaagaaaaagaggtttaattggacttacacttccacatggctggggaggcttcacaatcataatgggaggtgaaagcccattacatggtggtgacaatagaaaatgaggaagatgcagaagtggaaacccctgataaacccatcagatctcgtgagacttattcactaccatgagaacagtatgggggaaaccgccccatgattcaaattatctcccactgggtcctttccacaacatgtgggaattatgggagtacaattcaagatgagatttgggtggggacacagagccaaaccatatcagcttctaatccttttctgtccatctttctcatctgtaaaatggacaaataggatatgccacatatgttatattagcaagaaataaagtatttagcatagtgctggcaatatagtgggttttaagcatatgtgagtttcttttctcaaattcagattcatagctcatatacccaggaaaccccgacagcatttcacatgtcctacctctacaactaccctaaatgaagacctggagtagtgagggatgaccaagaagaaacttacaggctttgacaaagaacctgagttttatcctgaggccaatataaagttgaaagagtttaaactttaaatgctgagggattttaacacattcctctaaccaataggcagtatgacacaattaatacaatggtacctggttttaatttcctatcaattgtctgcactttaaatctttcttacagagtcaattgagagttagttaaatataaatatactatacatcagaaaggtaaaccaatagagatatttatgtagtaatatttaaatgtgccaaaggcagtgatatccttaaaacaagatcacttttagctgccctgctttgcacagatattgcagaatcttcaaaatagaaaaaggtattatgtatgaataggagtcatttgaattggaaaatagaaacttaaatcatcttgtccatcacactgtcaaggtagatttcctttaacatgctctatgacttaagatataaaagtgtaaaagaaaaagaaaagcttaaaatttctgaatattatcactttacttttttagggaataagccttaatatgtatctaatttgacattgttaatattttcatacttatataggcttgactttgattaaatcaagcaaactatcagtttgtctttagtgaatgaagtcttcttttatatatgtgtagcatataccttttgtttaattttctgtactttatttaatagtaatatatctggtacaataatcttaacaaaattgaagttttcagtaccgaatctagaaatgttggatgcctggtgagatgtgaataatttatatgtaaaaacaaaaactccaacctttattttccttttaagataactgaaataacaggttagttctaaagctcaattgttcattagaagttaaaactatgtacatgaaaagtaaccttaaaaagccagatgtttttcactctggtttgccttaattaagtcactgcctttagctactctccaataacagccaaaaaagacagtatgtaattgttttccagcatcagtcacaaaataattcacatatgattcagaaaacagccattatgtttatgttctatgattctgtattttcacacatataaagtttttataaaatattaaaatgatgctatttttaatgcttgggattttatctacaattttataaaaatttaatataaaaatgagtacaaaatatacatatggtatactgaaaaggattgaataccacatattcttgctaaccaatgcagtgaatgaaatcaattcatatctcagtagactcatgataatatctagcaagtggctatctaacacacaaattgccttgaaaagttctaccctttgcaaatgtcaacaatagagcaacatggaagaacgggttcttctcagatgtaatgaggcggtatggccaccagcagtgagtataattcttcaaaatcccaccctctgttagagttcatgttgtgacaccattttatttaaaagaagcaatatatcttcactgtcctccagatcttgacaaaatacatctcatggttaacaatagaccggaaagattatcatattatcacggctttgctcgtagagaacttttggagtctccatggctgatatgaagtaaccctatggagacaacaacaaagcctgagaagctcagccttgagccccaaacacttagcaggaattctgatacaaatttttgagtgattgtatgaatgagtgaactaatgtgttcctaagtgagagagatgaattacaaaacactacaagtaaatgaaacccctgtgaagaacattactgtcactgatatatgaaactcatttgcaaaaggggtttgggaacacagtaaatcacacttcgaaaagccagttctttcatgcatttcatggattgacaactgtaaaaagaagtagatggtgttgggtctttgtatttgaccactgctcttttcactctgcacagtttccttgggtgtctttttactcattttaatgtttttttcctgctacctttatatttaatattctcaaacttctatttttaatgcatatcatatactgggtgacagactctttaatataaatcagcctgctggacatatatacctggatgcttattcccacaaaagttcaaattctgcatttccaaagtggaatgtaccactcatatatatgaatcaagttcctctttgcctcaccgttttctagagactcagaccactccttccagtcttcgctgctgctgagcaaattctttttctttctttgctttgagcaactgttacaagaggaagtcatttatacggccttcaacaagagagttcagtgagactgaatcattggtccaacttattaccagacagcatctggcctgataacacatcctcatatagctctctgtcctctctactttattttccttttctctcttgtgctccacatgattgcatttttaaataaagtaagtagtagcacaggaagaatccaggctgaaacatcataaaaatttgctcctcttttggtggtatctgctgatgttatccacttttaccctgaaactgaagtaaaaattctaggagtcattcatgcctccttttcttcctcaatctgctagaaacatagtcgctaaatctagccatatttccttctaaagagcagatgcatcattcctctctatttttgccaacactgacttgcttcaggcactcatttttttcttattcaaaaaacctcctatctggttttcctaattccagtctcatttcttcatttttggctccacatctacaataaagtgattcgggtgcttcatctaaaatgcatatcttaaccctgattctcagcagctccaagctctttaacccatcacgccttcattatctgttctgagcttatgttttcaggcttatcaatcatgacttcccaccttaatttgtgtgtttccacaacaccaaacatggcaatattaaaaaatctctggctccttatctagagtgctttcctctttcctcttctggtaaactcccactttagaacaaagttcaggcattccttcttttataaagcatgcccacacattaccaggctgagaaaggtgactgtcttttgggcaacataaaatctcttatatatccactagaagagtgacccttgcttttgcttcgttttgttgtatcccatatcccagcatactcaatggatacgatattcattcaccaatttccctctatggcaggagttctcatcctatgagaaggctctacctctcccaaatacttgaacggtatttcagattctaacggaggaagaccaggtatagtggtacagtttctgattctgttatgcctgctttgtgctgggtttgggtatttttcctctcgtaaacccactccctgaaaataactacacaaatatatgctttacgaggagcagagtggaactgttttgtctttatatctcagtacctagacgataatctgaccatcagtagtagtaaaaggtcaatatatatttactgtgaataaatgaatgaatgaatgaatgaatactccaggaataaacctcaggcaaactgaggtcatttcttgctggggctgaatagtatggtactcttagaaatttgaattttgatttatatagtgccttagcgcacagaattctttgaggtgtaacaagtacatatacctggtaagtaggcagtcaaattggcaatgtctgtagaaaaggtgagaaggctggataataataatcaacaattatctgatagacttaaaggcactatctactgtaccaagcagtgtctgttgtatagctgaatgcctttgggaattaaaggccaaggaggttttctctctgacaggatgagctcagcatagatgactttgcactacgcagccatatagcactaaatgacttctgctctgtttattggtatctatccatcaatcacaggcattgttatggcaaccaaggaagtatttttatcatttgtaactccctcttttattataattatctgtgtatgtgttctccccccaatatactgtgagttccttaatgacagggactttatttatcttcacagcatagcaggagttaaaatattataaagtagaagaaaaaacaggtcagaatggaacagtagtgagatggaagctggaggaatatgatggaaccagatcagtaagtgtgttcaaggctaaacagaaatatcctgacaccttaggtaggttaaaattttagcagcctacattagtttgtataatcttcactgatgtaacaaatatatcaccaaattttagtagcctaacttaattattcattttagctcgcttagcagtctaatgctggtggttatattcaatgggactgagagaatagaggatcttaggaaacctccatcctttgatgccattcttggtggggggcttagagtcctcttcttccagaacgaaggtgaggggagaaagaatagatgacaaagtccaaagaatcatgtatcatatgttcgagtcgtaagtggcaataatttatttctcttcatacttcattggtgagaactaggtctatgttctacgttcttacacaagatattgacaaactttttccataaagagccaaatggtaaatattttaggctttgtgggtcatgcatttctgttacaactactcaactgtggttgtaacctgaaagcaaccacagataatatgtaaatgactcgatatggctatgttccagtagatgcaagagggatagaggagactgagcaaagtatcaatggctggcaactacttctaggggaagtagtttatattacggagcgggtatataagctcttctgttgcaaagctagtagaaaacttaacttttattctgaaggccataataagcatttgaaagactgccatctgtaaataccaaaagcagatattgaaaatatagatgcctgaggggactagaggatatgactcttatcagtgtcaccacagttttaaatatatgcaatagttttaacagagctgtcattaatcatgaacattatcatgaatgctattattccaaaatgaacaatctttttattgtttatagtaataaaatatgtaacctcaaatagtaacatctgaaaatgattcatttcaaattatatcatataggattatatttgtataagtaaaacaactatattcattttattgcaaaactgaaaatagtttcattttcctgaatgtttcatttcccaagtattaaaatagattttaaaacataaatattgatagctttcaattgtcaagtaaagcagacaatgcacaaaaatttgaaaaagacaggaatagaacattggaaacttttacagtgcagggaagtgaaactatatttcagttaaaaacttatgcaaaattaaaaagtcaaattggaatagaaataaatccaacatataacaaaagtctatgaattttgtatttgtactctgctcttaagtgtctttgtctctattttcttttattttagtgtattattctcatttattttttactggaataaaaataaagtagatactttaaaaaatgaaggtaggacatttggatttcttacgaaaagtgttattcttcttagaagattattcttgtaaatttattgggaatattgtcaaatatatatgaagatggctgattataacagttaacaaaattgaaataattcttgtgtccagacattgtgctaagtgcatggcttatacacaatatcatttattccttatatcagtcgtattattaccaatattattgtctccactttattggtaaggaaactgaagtacagagaggttaagtaattttcctaagattatgtcagtagtaagcaacacagctgaactttgaaacttggtgtgtctgacttttaaatcctctccacagaaatacaacagcttaactcaaacccacttccacaaaaccagcagttaagctctctagttcccatctgtgtaacacggcagaggcactctttctggagttgcagcatattaaccatgtgttgtaattaaatctctgtaacaaggagaaacaccttaaattacttttgggaatagcctttagattgtgaaatacatttgatagcaaaaatattagtcctggggcatggtccaaaagtttaaaaaataatattatgaaagttaattgttcttcatatgataaaagaaaataaattgagttgctagagagctaggggttaagggtttccggaataatgagttgagaacagattatagggagggcacagaagttagaataaggttgggactgaatccaagagcagatctttaagatttgaggtaagagtagtcaaggtatttctaagatcgaggatagctaatatatatttatatttacatctttgtttttttgtgctgttttctgaaatatctgacctcttctttgtgacccctccccaaccaaattttgtgttagttgctttttggaaaaattcaggaaaagggactacgttgacttttaggttgaggagaaacaaatgacaaacaacaagtacaataacaataactagaaatgataacatatatgctatgtatttggccccattctgaggatttaaaaaatatacatcaaatcatgcaatactctgtggtcagtattattgttatcatcaccatttatagatgaggaaactatgaagtcacataggaaataagtaatacaaccactattcaatgtatggttccagtgtcgttgttcttctttacagttctatatgatcgtttctaagctttagaatcagactgttaatgatatcaatatgtcactttactttaaaaatgtaagcagagactataacaaaaactatgcatttaatcttaaattcccttgtgaaatgggaaggacagaatttgcacatggaataaaggctcgattcattttgggaaattatgatttcacaaaactggtcactttattgctattatttaaagagtagccaaatacatgtatgtgtacaaacatttaaaatgaatgtttgcttaaaagtagggtttctagatagttaccacaaatgtataaaaacatgttatatgctttataacttactcccttttgaaaagcaaatcatgtccaatttagtgacattaatgatattttgagatgatatgtgggggtggataaaagtggaaaatgatctctggtgctttctatctttggtttctgtatcatttccttctattaaaatacttctgcctattatcacaacacattccttcaggaatagtaattatttaaaagaggatggcagggtaacataacatttagtcctgagtcattatccttatatggaaaaatttgagaatgtgtaataaagggtaagatggtgtttggatataaggtagctttaaaggtgtatgtaaatgctatgtttcttgtagttaattttttttaacaaagtattttttaaaattatccatattgatgcatagagatgtattttattcttttctctgacttataagtattactattccattttatttattacatttttaaacgtccatttctctgctttgcaatgttcctactatttctaataaggctattcagagagtcattagattacatgtgagtgcttctgtagggaagaaactagaggtagaataactgatttagctgttcttaatatcgtacctgtctactctgcctgaatgagaaatcaatctttcatattttaggcataagacataagcaaatatgtgataataaaatttttgtgcctgaggtatacgctacctaattattaagaacacaggtgaaacaaatgtaggtgactataaaatagagatagaaaatgctataagagttaatccaaagtttgtcatatacacagatataattagtatcaactttactgttggaaaaaaccttggtaaaatgattcaagcaaacataaaaccaaataacaatccccatcaccaaataaaaaccaaaataccaaactggtgaatcagtttctctgtcaatgctatgttaagaactattgctagattttcttatatcagcataaagctgactgcaaagaagaggtgaggaaatagatcatgctattctaaaaatttaaatattttgataaatttaaaaaatgtgtcactgagcatcaggcaagagatttataatttgtggtgatagtcaccttacttccttcatgtgagtaggacttttagcttctcaataacagaacctcagtgatataattaatataaaatagtaaggtaagactacattccctgtaataaaatcctgcatcacatgtcgtcttccaaggaccatctgtccagatgagccttgctgtaataatcaagtaaacggagccaccagacaaattagtggagagcttcaattctcatagtgtcatctgggggttatttaaatgttatttgactttttcactgtggttatacttgcactgatagtcaaagataatagtggataaaactactgatggcttagtatgatacaaatagtggcaccacctgtactagataagagtattatcactttaatttaaaaaattaagattatacttgaaacagtggtaacactaactttattcaaatataagttatgaattacatgcctttttaataaagtgtatgatgaaaaggggggtatgcataatgtatttctgctgtatgctggagtaagatgattgcctcaaggagaagcatgagtcatttttgatgtgtaagaccaactagctgctaatttttgtggaacacagttttacatgaaagaataactaatattcagctatggttatgcattcttgggttattgggtagacattttctcaaaaagaaaatgggtctggccgggcacggtggctcacgcctgtaaccccagcactttaggaggccgaagcggggggatcacgaggtcaggagatcaagaccatcctggctaacatggtgaaaccccgtctctactaaaaatatttaaaaaattagccgtttttttagttaatgggtgcagcacaccaacatgcacatgtatacatatgtaacaaacctgcacattgtgcacatgtaccctaaaacgaagaagaaggaagaaaggaagaaaggaagaaaggaagaagaagaagaaggaagaagaagaagaagaaggaagaagaagaggaaggagaggaaagaagaagaagaagaagaagaggaagaagaggaagaagaagaagaagaagaagaagaagaagaagaagaagaagaagaagaagaaagaagaaagaagaaagaagaaagaagaaagaagaagaaagaagaagaaagaagaagaaagaagaagaaaagaagaagaaaattagccgggtgcagtggcgggcgtctgtagtcccagctactcaggaggctgaggcaggagaatggcgtgaaccgagaaggcggagcttgcagtgagctgagatcgcgccgctgcactccagcctggctgactgagccagactccgtctccaaaaaaaaaaaaagaaaatgggtctgccactccaaagaaaacagctaacagcatttgttgccaatgttacaattcgaactttcaagcatatttcagaattttgggtaagtcatccaccatggtcagaatgacagctatacaatacttaaaaacttttctgatgagactggaggggatattaacaaatattatttttaaatattttataaagatatatgttgacatttggtagagctgaataactcaagagaccaatattttggcagcaaaaaattgtgcatgagtaaaagatccattcaaaatgcagatagagcaatgaatgttaatttaattgagtataaaatgcccattgattgggttttacattccactttttaactcacctttaacaatttattagttatcaagttttggcataatatcaaagaggggtactctaaattatttgaaaagtctattaaaactcttctatcttttcaaaatatgtatgtgttgggaggccagaatttctccaactacttcagcaaaataattacaggacagattgaatgcagaagcacatatgagaatccagctgtatttattaaagcaggtattaaatatgtttgctgatacatataacagcgccattcttatcattacttttatttgttttggaaaagtaaaactgtttttcataaaacatgctatgctatattattcatgttaacttatgagtttatcattttataagaattaataaaggaaataaggcagagtagagagcactagtaaacctatctccccacctagacaacaattgtactggcagaatatatatatatatatatatatatatatatatatatatatatacatatatatatatattttttttttttttttttttttttttgagacggaatctcactctgttgtccaggctggagtgcaatggtgtgatcttggctcactgcaccctctgcctcttgggttcaagcaattctcctgcctcagcctcccgagtagctgggactacaggtgtgtgcaaccaagccaggctaacttttgtatttttagtagagacggggtttcaccacattggccagactggtattgaactcctgacctcgtgatccaactgcctgggcctcccaaagtgctgggattacaggcatgagccaccacgtctggcctagaatatttttgatgtaactattttgaaatagtgaagtctattgaaggtttacaaccttccaggtgaaggcttctaaattaaattgtgattaattttggtcagtttcagctcttaaaacagtagcatgcacacacgtcccacttcttagtcatgtggcaggcagttgtgtgcatgtttctggtgtagtctgcacacagcttgtgacggccatggtggacagaaaggatcctcttcttcacatattagacatctgtgctttgatcactgattactgcttctgataatagagctgatgatcagtgaactagatggtggtcattgtcacacttcccccccattgttgttactccccaccaccttgaactatttttctcctcattgtttgtctcttttcacacttttggaagctagccattaaagattggaacattcaaaaataactgcatatatgaggaaaatttaaaaatggccatccatgcccaggaaagggtttataaaagaagacttgagaagtctttaagaaactccatgtaaaacaacaacctcagagctacatggatacatattaaaaccagacttttgaaaactaaagacgaagtgaaaatcttaaaagcagcaaaagaaaatgacttttcacatacaaggatcccaataaaattatagatttctcatcagtaattttacaggctagaagacaaaagtttaaaatattcaaaacactgaaagaaaacaactctgtaaaccaataattctatatttgacaaaacagtcctttcagaagttagatagagctgggtgtgatggctcacacctgtaattccagcactctgagaggccgaggcaggtgtatcacctgaggtcaggtgcttgagactagcctggccaacattgtgaaacaccatctctactaaaaatacaaaaattagccaagtgtggttgtgtgtgcctgtaatcccagctactcaggaggctgaggcagtggaatcacttgaacccaggaggcagaggttgcagtgagccaagatagtgccactgcactccagccttggcaacagagcaagattctgtctcaaaaaaaaaaaaaaaaaaaaaattaggtagaaattaagacattcccagataaacaaaagctaagaaagattgttaacactggaccttccttgctagaaatgctcaaggggaatcctgcagtgtgaaatgaaagaccatagacagtaactgtatgttgaatgaagaaataagagtaaattaataggcaattattaaagttaaatggcttataatgcactttttgttttataataatttctaataattgttttctaaataattaaacagattaatacattaaaattgttctaatagtgttataactttggtttataactttatattttgttttctaaataatttaaaagactaatgcatttcaaaaattactagttggggggggcacacaatgtataaagatgttatgtataaagatgtaattttgtgccatcaacaatcaaaaggagtgggaacagagctgttaaaggagtagagtttttcttgttataaactcaacttagagtgttaatgactttaggctgttaatcgcatggtaactacaaagaaaatagctatatacaaaataaaattagaaaaaattttaaatacttcactataaaagataaactaaacacaaaaagatggtaatgtaaaaaatgagagacaaaaactatcaagaataaggaacacatcacaaaatagcagaagtaaatagcttcttagcaattattttaattataaatgattgtactcttgaatcaaaaaacagaaacctgcagaatggataaaaacacttttttcaactatatcctctctaacaaagatttactttagatctaaaaccacaaatattaaatagattaaaactgaaaggatggaaaaaaataaatattatatgcaaatagtaaccaaaagagattaggggttgctagcttaatatcagacaaaatagactttaaattaaaaaatgttaaaaccaaagaaggacattatatgttaataaaagactcaatacagcaagaagatataacaacatatataaatgtaggagttcagtcagggtggtgggaaaaattgtaaaatagacacaaaccttcttggaaggccggaaggttttgcaaaagcctaaggatagggttatgggtgaaggcagcctaatcctcttaccctgagttaatagcttaaagtaggtacaaaggaatgtaagggagtttatctacatagcttgtttactcatgtggtcctaagaccaacctttgatcattcacagaactgatctctctgggagagggtgaccagattaattacccaaaggcgtgttaactcaaagcctttgtcattaaatctgtactgaataaatgcctgcagagccagctagtcagagtgtgcatgcggctgctacaactctgtgattggcacagccccctggcctactctttcactgaatatcagtgtctgagtacattattcatccattgtgcagcctaggtctgtgggtcagaccccagcaggtggtgcctcgtgtgaggaacgctgcaacggactggtgattgtgacggaacccttgaaaacgaaggtgaaaaggactgtgcagtcagtaagtcattggtgcctgcttgggatttccaagttcacagggattgttcaggctaggatttcatcatgggacaacagttatcagctcaacagaaacagtacataaaattattgaaacagctgcttaaagctggtgaagcctcagttttgcaggctcaattaagggacttaatgcaaactgttgtattccataaccaatggttttcagaagaaggtatgctaaacatagagctctgggaacaagtgtggagaaatcttaacatcatcagcagtgggtcccagtatcatctctaacactatgggctttggtgaggttggctctggtcccattatacacagaagagcctaaaaaggagaaggaggaagaactgttacctaccttaccacctccttgtccctcagacacgctatcaccaggccaaaataacaaagaggaaatggaggtttgcctgagtcccctcctctaataaattgggaaaaagacaagggataccctagttatgggaccctatcttaggcaagtggcattagaaggggagttcttagcctacctggtaatgcaagatcaacaaggcaatcaggtatataaacccatttattttaatgcttataaaaaaataagaaaaggcattagaggctggagccacgtggccaagtttgtgatgggtggaagaaaaagcttggtagtggggaagctcatgacaccccaggccgacaggggccgcggcagggggcagaagcaacacagacaaaaagcagcacctaggcaagtgcaacactgctgccgtctagctccgtgggcagcccatggcaaaatttcttgtgtttcttgtatacaagcgacatcccagagtataattctctgctaagatataagtaaaattgaagaatttaaaagacctctttctgataatggccactgttgttatttctcccttactcctaaaacgactccaaatcccatttaagtaaaacagtaactgctggagggagagaaattaaaaagagcccatgaattagttgaggagcaattaaaagccagccatatggaacaatcaaacagcccctggaattcgcccatttttgtcattcccaaaaagtctggtaaatgaaggttttgcatgacctacgtgctattaatgctaatttgcaacctatagggccccttcaacagggccttccctccaccgcagtgattcctcaagattggcctacaatctttattgactgcttctataccattccattagcagaacaggacagagaaagatttgcatttacaatactggctatcaataatgaaaagccaggttgctgatttcattaaaaagggtgtcctcaagggatgctaaacagtcctaccatgtgtcagtatcatgtaaatcaagctttgctctctagtagaaaagaattttctgattgcaaggttattcattttatggatgatgttttactagcagccccaacagagccagtactttcaaagttagatacctctgtcataaagaatacacagttaagagatttaatgattgcgcctgaaaaattacagatgtctcctccttggaaatatcttgggtacatactaacttcctggtcagtaagacctcaaaagcttaaattaaatactaaaaacttacgtaccttaaatgattatcagaatttactaggcgatattaactggctttggcccaccttgggcctacctactgataggttgcaaaatctcttttctatcttaaagggcaattgagccctggattctcccaggtatttaactcctgtggcaaaaaggaaaatcaaggaaacagaacagaccatttctcacaggcaacaagattgcatagacccagtctattcaattcaattgtttatttttcccactaaacactaccctacagggttaataggacagatggccccagtactatgctttctagaatgggttttttgctcacataccggaactaaaacactttccctataatcagtaaagtcatatattcaggcttcagacaatgcaatcagttgctaggttatgatcctgatatcatcaggattcctttaagtaaaaagcaatttgaagcagtattgccattatctatagatctgcaaatagccatctctgattacgcaggccatgtagaccttgcccttcctgctgataaaccccttcagttcttatctggtacttctgtgatgttacctacaaaaatagttcactcccccatacctaacgctttaacactgtttactgacggttctggtaaacatgggaaagtggccatttggtggagaccacataatttcctccattgttctgggtttactagcactcaaaaagctgaggttggggccttaatattggctttggagactttttccgctcagcccatcaatattgttagcgactctgcttactctgtttatttactgcagaaccttgagacagcgctaattaagtccactctaaagcacaccctgtgtgcacttttcctctgacttcaccaattgctaaatcaacgtacacatcctatttttattacacacattcgagcccacagctcactgcccggtttattggcttatggcaatgatcaaccagaccttcaggttgtgacgtcactgcttgaccaagccacccaatcacatcaattcttccaccaaaactggagaaacttacctaaacaatttcaacttacccagagactagctaaacaaagtatcctgcaatgcccagattgccagctcacaggcacatcccctctttcaacaggtgttaaccctagagggttctagtcctctaatcagttatggcaaacagatgttacacacatccctaaatttggaaacttagatatgtacatggatcaattgataccaacacttatctaattagtgcacatgctcttcctggagagtccacctgatatgtcattaaacatctcctttcaacttttgcatttatggggcagcccacaaaaattgaaactgataatggtccagcttatgccagctcacaatttcaacaattttgtcacacgtggaatatccaacattccataagcatctcaaataacccccaaggacaggccatagaacgtgcccactccatccttaaaaatatgctcaaaaaagggggagtatgagtaaggaccctgcaacactagtagcacaagccttatttacccttaatttttaaaatttagataaatttcaatcagcaatggaaaagcactttgctaaaacctctcaagacataaaacctgcacttttatggaaagatgtaaacaataatgaatggtgtggtacaaatgaattgctaacatgaaaaagaggatatgcttgttttcacaccccctcaggtcctctttgaattccagcacgatgcatcaaaccataccatggcatggctaggacccaacccagtaccagaaatgaagaaaaggaccctacaggacccgcatccccatgctgaaaaagacaactcaagaggctgaacaaatcctgctccagacacacacatcattcactccaggtaatgtgttacttgctatgctttattaacctttttaaaattctctcactctgcctgcatgtggtacctgctacacttaagcaccgacttccggcttctaacattgcaactgcttggccaagagagattatcatacccccagtggggttccttagtaacagcacacatggaactaaagtgccaagtaacactacaggtcactccttgattggaaaagaatgttgctaataatactcatgtttgtcttatgttatttactaattctaggattcaaagctggaatacgagcagtgaccagcatgcctgacaggcctgttgctacacacatctgtactcttcaatcaacaaagcctgatgcaaaataacagaaaagggggagatacaagagttcagtcagggtggtgggaaaaattgtaaaataaacacaaaccttattagaaggtcagtaggttttgtaaaagccttaggatagccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaagcctcagggtagggttacggctgaagtcagcctaatcctcttaccttgagttaatagcttaaagtacatacaaaggaatgtaagggagtttatctaaatagcttgtttacccatgtggtcctaagaccaacttttgatcatcgtgggtgaatgattgctctctactcaggggtttggcaatgtggcaatgttaattaccctctagtggtgtttactggagacttttgtcatttaatctgcactaaataaacgtgaacttcaccagcttttgaggccgatgctgcagactctgacagcagagccccttagccacactgacaggcaaaatatctgtgtccctgtacatctttcatctgtcactgggtcagcttctgtgggacagacctggcatataaacacttagctgattacagattatcaaaatatatgaagcaaaaaagacagaatttaagggagaaatagacaattgtacaataatagtggagaattaaatagccactctcaataattaatagagcaacgatgtaaaagataagtaaggaaatagaggacttaacacaacaaaccaactagatctaacagacatacacagaacatactacacaacaacaacagcatacacattcttaaaagcatgtggaacattttccaggatagactatatgttaggccacaaattaaatctcaatagatggaaggacatatgtcatataaattatcttttctgatcacaatggtttccaggatagactatatgttaggccacaaattaaatctcaatagatggaaggacatatgtcatataaattatcttttctgatcacaatggttaaagttgaaaatcaaaaacagaagtaaaaccagaaaatttataaatttgtggaaactgaacaacattctgtttaacaaccaaaggatcaagaaataaattataatggaaagtagaaaatagagacaaataaaaatgaaaatacaacacacaccaaaatgtacgagatgcagtgaaagcagtggtaagggggaaattcatagccattaatgcttgtgttaaaaaataagaaagatctcaaattcaacaagttaactaaaacttaataagctaaaaaagaagaaagaacaatctaaacccaaagtagagatgacattgatgataacaaagttggttgtttgaaaaactcaacaaaattgacaaatctttagttagatggattaaggaaaataaaaagaagactcaattaactgaacttagttgatgatattgtaaataaaattgattttgtaattactttttcagattgctcatgcttagtgggtagaaatgcagtttacttttggttgacttaaccaaagcagtgaatgtcttctacaatagaaactactaaacattgctgaaagaaatagagacataaataaatggaatcacatctcatgtttatgaattggaaaaaagtgatatacagatttggtgcaatccccaacaaaatcccagtgatttttttttttcagaaataaaaaaataatccacttaaaattcctgtagaatctcaatgtactctgaacatacaaaacaatcttgaaaaataacaagactggtggtctcacacttactgtttcaaaacttaattacaatgctacctttgtaattaaaacctttttgtattggcataaagaccaacatattgactaatggagtagaatgagaagcccagaaataaacccttatgtatatgatttttgacaagggtgccacatacattcaatgggggaagaatggtctggtcttgtgaacatatggtgttggagaaactggatatccacatacaacagaatgacccaaatagttggacccttacctaacaccatatacaataattaactaaaaatggattaaaaagctgaaactttaaagcttttagtagaaaacatagggaaaaaggctcacaacatagaatttggcagttatttcttggatatggatatgacaccaaatgcacaggcaatgaaagaaaaaacagacattagacttcatgaaaactaaaaagaaattgtgcatcaaaatatattaacagagtataaagacaactcagaatggaagaaaagacttgcaaatcatatatctgataagggattaatattcagaatatatagagaactcctaagactaaacaacaaagaaacaatccaattcgaaaatggacaaaaaatcaaatagaaatgtctcaagagaagatatacaaacatccaatatatacatgaaaagatgctcaataacaataattagggaaatgcaaatcaaaactgtgaggctcaagtcatcccacagggcttctaaaggaaaagagggtccaaaaatccagatggctagagcttctctgggcttgcatgaggagcaacctcacattgattaagatgtgagcttttatgctgtcctgtgatcaaataacccacctcaccatgctatcttacttctgcgtttccaatttaccataatactcccaaaataaccccttttataaggggtcattttaattgtctgagttccctcttaataacagggaagaaacaaaattttaaccacttcttaccaatgcatgaatgactaatattgtctcaaatgtgttatctctttagttcacccaattcaaagccatgtttggagatttctgtatccagaagcagagtctgaaagaaatacgtctcccataatggaaactgaagaacaaggacaactttttgagagtgataatttggaaaaagaatgtattttagcactccacacaatataacacaggcatgcttgtcagcatgcttcatttttaaactaactctgatagaagatgttttctgattgtgactcattatttgttggatggtatattttatatagcacaaaaaagataccctttataagtaatggtccatcttaattgggatataacttaaaaattcaataaactgtaaaagagtgaagtagaacgtaggaatgtgaagcaaaaacaaagaaacgaaatatagtgcagccttcattagattatttcaattggaaatgatatcttttggtgtggttatttgaacaagttattagaaaaatcactactgctattttacctgcaattgttaatgtgatagtttttcactgccttggatggaatgaaagatctccagttatttatttctataacttctatgcagccagtaaaattcttgactggtacaggcatctgagagagagagagagagagagaagtagagataatttaaatgattttcttgaatatattattcttgcttcaaactggtcagggtatgcaactggatttggaggctgatttgatttattctacttatttatagtacagtaattcaaatattttcataaatatcaatccaaaaagtaataggatttttccatatcttggctattatgaataatgctgcaatgaacatgggcaaaattataaagaaattatgtttgtgtacatacaaacacaatgctattcaaccttataaaagaaggaaatcctgccatttgttacaacctggatgaaactgaaagatattatgctaagtgaaataagttagacacaaacatatgtgattatctcacttataggtagactctaacaaaatgaactcaaatacacagaaatagacaccaaatctgtggttataaagccaagcaaggtctgaggctgtgggtggggaaaaaatgtgcagatttaggtcaagagatacaaagcatcagatatttagaataaacaaatctacagacctaatgtgtaacatgaggattatagttaaaaatattgcattgtatttgggacttttggtgaatgaatagattttagctgctcttgctacacacagatgaaaaatgggtaactatatgtgataatggatgttaatttgcttcactatagttactattttactacccatatgtatctcataacatcatgtatctcataacatcatgtggcccataccttaaatatatacaataaaatttattttaaaaattagtaggaaagaatgtcaccttattcatcaaaagttactcatgcctatatatcttagtactgtatagattacatagtcactaatacttaaagaaaaaattacataattacagtaaattatcaatgaaaaatagaagaaaagctaatacactcatccttcccatcaaggcactacatttttccatctttggcctgtttcttgcagttttttctctcagacatcaattaccttgccttatctgcagatatcaaaacattaagaagaattgctcttctagggaccaaagctaacaaagtaatctataaagatttgtgatatattttacatgccttttgtgttctgcagcctgtcctccttaggaataagttggggaaaaatgataacaaaaagatactaagggtccaagaacaagaagagaagtacattgaagaacattcaatttggtgaacaaaaataacctaatcattacgagcatacaatattatactagtaattacatgtgtatctaaatgtatatttatgagaaaaagggaaagtaaaagtgaatacagctcagaatttaatagttagaaatgagcattcattcagatgctgtcctctgataagctcttaatattactaaaaatttcaagcttaggtgaaccaaattatgaccagagaaaccattaaacttacatactgaaaaatatattagttatcttaatttttgaattaaaattatacactatttgcatctcaagactttgtatcttattgaatatattataaataatagaataaggcctttgtcttgtttagaaatttcaggattaatatatttcactttttaaatcatagtttagaacctttgaaagtttgctataggctcaaatttactgcaaagactctcacctggtaatactctgtcaaacgtcaaaaatgactgaactagaaaataaaacaatatttcacacagtaagtttacaaacaagtcaagtagattccaaagaaactatttaatggaagcatttggcttttatatgctgcagttgggaaagtactgatttgtcattgttaaagtttctctagctttattaatgtttttaatttttagatttaattcttatttttactgcagttatatacttaatttaaaaataaagtttatgactatgtctcctgaaatattatagtttactattaaaaaaatgatcttataaaaatgcttttgattataatgatagtgaatgttcaaacttaaatctgacatagctcagcaatggcataaaagtatgtttacattgcagtacatatttttctctgttaagatccttattattcatagggataaaaaaaggggaaactgataatgtttaaattaatataaacacattaaagagccatgaaaaatggtctataaaggaaatgactctatgattactctattgagatacttctcagaattctataattcaatttcattcacacattatgaattaaaaatgcatattaatttattcaccttgggctttgaaaaatggcaagaaaaaatttcccagccattagcctttacatttgagtaaattcaaaatttcttcatttcttatgttttaatagactgaccactctctagttctatcacacattatctttttgcagtactgttcggaatagttatttagcttccaaataaattcccactttttttttcactttaaatatacaaacaaccttcttataaaaatgtgagcaaaggacatgaacagacacttttccaaagaagacagacacgtggccaaaaatcatgtaaaaaaacaaaagctcagccaggcacggtagctcatgcctgtaatcccagcactttgggaggccgaggcacgtggatcatgaggtcaagagatcaagaccatcctggccaacatggtgaaaccctgtctcaactaaaaatacaaaacttagctgggcatggtggtgcacacctgtagtcccagctactcgggaggctgtggcaagagaattgcttaaaccttggaggaggaggttgcagtgaaccgagatcgtaccactgccctccagcctggtgacagagcaagactccatgaaaaaaaaaaaaaaatgctcaacatcactaattaaatgcaaatcaaaaccacaatgagataccatctcacaccagtccaaatggctatttattaaaagtaaaaaaaataaaaaaaaaaataacagatgctggcaagattgtggagaaaaaggaatgcttatacaccattggtgggtgtgtaaattagtccagccatcgtggatggcaatgtagcaattcctcaaagccttaaagactgaaataccactcgacccagcaatcccatcactgggtacatacccaaaggaatataaatcattctataataaagaccatacacatatatgttcactgcaacactattcacaatagcaaagacatggaatcaaccaaaatacccagcaataatagattggataaagaaaatgtacatagacacaatggaatactacacagccatgaaaaagaacaaaaacatgtctattgcagggacatggatggagctggaggccattatccttaggaaactaatacagaaaaagaaaatcaaataccacatgttctcacttagaagtggaagctaaaggatgagaatagctggatacatagaggtgaacaacatgcactaggtctattgcctattggagggtagagggtggaagaagggagaggatgaggaaaagtaactaatatgtactaggcttaatacctcaatgatgaaataatctgtacaacaaacccccaggacaacagtttacctataaacctgcacatgttctcctgaacttaaaatagaagttaaaagaaaaaacatattttaaaaggtgaaaaaaaagagagagagagaaagggaactgagcatatgagtgaacaaaatgggaagactggactgaattttttttgtgtactttaagtgctggaaccacgttgaatttatcatttatataaaagtataatttaaaagctcaaagttaaaaatcaaaagaacaaattttctgtaaggctaaatttatccaatcttcatttatttcaaaggttcttgtttttataatggtgatagttgatagtagatactgtttttgatttttatttaatgtatttagttttttaaataaaaataatttattaaaattaataaagcatatattaacatttcattttgtaaaacataagtgaaacctgaactcaagtactgagccttaatactaaactctaaagcacatggtttttagatcatttctactgttgggaaaccttttttccttgaatttgtgtttataataatcaggttaattaggtttctgggacaggagtcttaaaagtaatagaagggaaacaaagatacacaattcatatgacaatttgtaatgtaaaatatatataatagattaaagacaagaaataattatctgcattagattataagaatggtaccattgcatggtatcttcatttaaaaaattgtagtcacgtgctgctgtgatttctcaaatatagttcttattattaatccaggacaaataactcctggttatttctaaacaatgtaaaatggcaatgtagtatgccaaatcatagcactaggaatataattcatggtactaagcattaataataaaaacaaaattctcgagctcgctggcaagatggctgaataggaacagctctggtgtgcagctcccatcaagatcaacgcagaaggcaggtggtttctgcatttccaaatgaggtacctagttcatctcattgggactggttggacagtgggtacagcccacagcaagccaaagcaggatggggtgtcagctcacccgggaagcacaagtggtcaggagatttccctcccctagccaagggaagccataagagactatatcgggaggaacggtgcactctggcttagatactgtgcttttcccacagtcttcacaaccggcagaccaggagactccctctggtgcctatgctaccagggccctgggtttcaagcacaaaactgggcagccttttggggaagccactgagctagctgcagaaggtttttttttttttcataccccagtggcacctggaatgccggcgagaaggaagcattcactcccctgcaaaggggcctgaaaccagggagtcaagtgctctggctcagcaggtcccaccccaacggagcccaacaagctaagatccagtggcctgaaattcttgctgccagcacagccatctgaggtcgacctaggatgctcgagcttggtggggggaggggcttcggccattactgaggcttgagtaggtggttttaccctcacagtgtaaacaaagccactggtaagttggaactgcgtggagcccactgcacctcagcaagggtgctgtggccagactgcatctctagattcctcctctctgggcagggcatctctgaacaaatggtatcagccccagtcagggacttatagataaaatccccatctccctgggacagagcaactaggggaaagggtggctgtgggggcagcttcagcaggcttaaatatccctgactgactactctaaagagagcagcaaatctcccagcacatcgtttgagctctgttaagggacagattgcctcctcaagtgggtccctgacacctgtgtatcctgactaggagacatctcccagtaggggctgacaggcatctcatataggcgagctctggctggcatctggctggttcccctctgggacgaagcttccagaggaaggaacagacagaaatctttgctgttctgcagcctctgctggtgataccaaggaaaacaggatctggagtggacctccagcaaactccagcagaccagtagcagagggaactgactgttagaaagaaaactaacaaacagaaagtaataacatcaacatcaacaaaaaggacgtccactcagagaccccatctgaaggtcaccaacatcaaaaaccaaagatagataaatccacgaagatggggagaaaccagtgcaaaaggctgaaaattccaaaaaccagaatgcctcttcttctccaaaggatcacaactccttgcagcaagggaacaaaactggatgaacaatgagtttgatgaattggaagaagtaggcttcagaaggtaggtaataacaaactcctctgagctaaaggagcatgtcctaacacaatgcaaggaagctaagaaccttaaaaacaggttaaacgaattgctaactagaataaccagtttagagaagaacataaatgacctgatggagctgaaaaacacagcaagaaaacttcatgaagcatacacaagttgcaacagccaaatcgatcaagcagaagaaaggatatcagagattgaagatcaactcaatgaaataaagcaagaagacaagattagagaaaaaagagtgaaaagaaatgaacaaagtctccaagaaatgtgggactatgtgaaaataccaaatctaggtttgattgttgtacctgaaaatgatggggagaatggaaccaaattggaaaacactctgcaggatattatccaggagaacttccccaacctaacaaggcggatcaacattcaaattcaggaaaaacagagaacaccacaaagatactcctcgagaagagcaaacccaagacacataattgtcagattcaccaaggttgaaaagaaggcaaaaatgttaagggcagccagagagaaaggtcgggttacccacaaaaggaagcccatcagactaatgatggatctcttggcagaagagggtggggaccaatattcaacattcttaaagaaaagaattttcagtcgagaatttcatatccagccaacctaagcttcataagtgaaggagaaataaaattcattacagacaagcaaatgctgagagattttgtcaccaccaagcttgccacacaagagctcctgaaggaagcactaaacatggaaaggaacaaccggtaccagccactgcaaaaacataccaaattgtgaagaccactgacgctatgaagaaactgcatcaactaatgggcaaaataaccagcaagaatcataatgacaggatcaaattcacacataacaacactaaccttaaatgtaaatgggctaaatgccccaattaaaagacacagactggcaatttggacaaagagtcaagacccttcgctgtgctgtattcaggagacccatttcatgtgcagagacacacacaggctcaaaataaagggatgtgggaagatttactaaacaaatggaaagcaaaaaaaaaaaaaaaaaaaaaaaagcaggggttgcaatcctagtttctgataaaacagacttcaaaccaacaaagatccaaagagacaaagaagggcattacataatggtaaagggattaatgcaacaggaagagctaactatcctaaatatatatgcaaccaatacaggagcacccagatttataaagcaagttcttagagacctacaaagagacttagactcccgcataataatagtgggagactttaacacgccactgtcaatattagatgaatgagacagaaaattaataagcaccacatcacacttattctaaaattgaccatataattggaagtaaaacactcctcagcaaatgcaaaagaaaaaaatgataacacacagtctctcaaaccatggtgcaatcaaattacaagtcaggattaagaaacacactcaaaactgcacaactaaaggaaactgtacaacttgctcctgagtgactgggtaaataacaaaattaaggcacaaataaagatgttctttgaaaccaatgagaacaaagacacaacagaatctctgggacacatttaaagcagtgtgtagagggaaatttatagcaataaatgcccacaggagaaagtaggaaagatctaaaattgacagcctaatatcacaattaaaagaactagagaagcaagagcaaacacgttcaaaagctagcagaagacaagaaataactaagatcagagcagaactgaaggagatataaacatgaaaaacccttcaaaaaaatcaatgaattcaggagctggttttttgaaaagatcaacaaactagatacaccaccagccagactgataaagaagaaaagagagaagaatcaaatagacacaataaaaaatgataaaggggatatcaccaccgatttcacagaaatacaaactaccattagagaatactataaacacctctacacaaataaactagaaaatctagaagaaatgaataaatttctggacacatacacactcctaagaataaacaaggaagatgtcaaatccctgaataataacttctgaaattgaggcagtaattaatagcctaccaaccaaaaacgtccaggatcagatggattcacagccaaattctaccagaggtacaaagaggagctggtatcattccttctgaaactattgcaaacaatggaaaaaaagggaaacctccctaactcattttatgaggacagtatcatcctgataccaaaacctggcagagacacatacacaaaaagaacatttcaggccaatatcccttatgaacgtcgatgagaaaatcctcaataaaatgctggcaaaccgaatccagccacacatcaaaaagcttttctaccacgatcaagtcagcttcatccctgggatgcaagcctggttcaacatatgcaaatcaataagtgtaatccacaaagaggagctggtaccattccttctgaaactattccaaacaatggataaaaagggaaacctccctacctcattttatgaggacagcatcatcctgatacgaaaacctggcagagacacatacacaaaaagaacatttcaggccaatatccctatgaacatcgatgagaaaaccctcaataaaatgctggcaaactgaatccagccacacatcaaaaagcttatctaccacgatcaagtcggcttcatccctgggatacaaggctggttcaacatatgcaaatcaataagtgtaatccatcacataaacagaaccaatgacaaaaaccacatgattatctcaatagatgcagaaaatgccttcaaaaatattcaacaacccttcatgctaaaaactctcaataaactaggtactgatggaaagtatctcaaaataataagagcaattaatgacaaacttacagccaatatcatactgaatgggcaaaaactggaaacatttcctttgagaaccggcacaagacaaggatgccctctctcaccacacctattcaatatagtattggaagttctggccagggcaatgaggcaagataaagaaatacagggtattcaattaggaaaagagggagtcaaattgtctctgtttgcagatgatgtgattgagtattaccaaaccccatcgtctcagcccaaaatctccagaagctgataaacaacttcagcaaagtctcaggatgcaatatcaatgtgcaaaaatcacaagtattcctatacactaataacagacaaatagccaaatcatgactgaactcccattcacagttgctacaaagagaataaaatacctaggaatacaacttacaagggacgtgaaggacctcttcaaggtgaactaccaaacacggctcaaggaaataagagaggacacaaacaaatggaaaaacattccatgctcaaggataggaagaatcagtattctaaaatggccatactgcccaaagtaatttatagattcaattctatccccatcaagctaccattgattttcttcacagaattggaaaaaaactactttaaatttcatatcaaaccaaaaaagatcccacatagcctagacaatcctaagcaaaaagaacaaaactggaggcatcatgctacatgacttcaaactatactacaaggctacagtaacacaaacagcatggtactggtcccaaaacagatatatagaccaatggaacagaacagagacctcagaaataccaccacacatctacaaccatctgatctttgacaaacctgataaaaacaagcaatggggaaaggattccatatttaataaatggttttgggaaaactggctgcccatatgcaggaaggtgaaactggatcccctccttacaccttatataaaaattaactcaagatggattaaagacttaaatgtaagatctaaaaccaagaaactgtagaagaaaatctaggcaataccattcaggacataggcatggcaaagacttcattactaaaacaccaaaagcaatggcaacagaagccaaaatagacaaatgacatctaattaaagagcttctgcacagaaaaagaaactatcatcagaatgggagaaaaatttttaaaatctatccatctgacaaagggctaaaattcagaatctacaaagaacttaaatttacaagaaaaaaaaaaaacatcaaaaagtaggcacaggatatgaacagacaattctccaaagaagacatttatgcagccaccaaacagatgaaaaaaagctcattttcactggtcattagagaaatgcaaatcaaaatcacaatgagatactgtctcatgtcagttagaactatgatcattaaacgtcaggaaacaacagatgctggagaggatgtgaaaaaatagaaacgcttttacactgttggtgggagtgtacattagttcaaccattgtggaagacagtgtggcaattcctcaaggatctagaactagatataccatttgacccagcaatccctttactgggtatgtaaccaagggattataaataattctactataaacacacatgcaaacgtatgtttattgtggcactgttcacaatagcaaagacttggaaccaacccaaatgcccatgaatgatagactggataaagaaaatgtggcacatataaaccatggaatactatgcagccatgaaaaacatgaattcatggcttttgtagggacatggatgaagctggaaactatcattctcagcaaactgacacaagaacagaaaaccaaacactgtatgtcctcactcataagtgggagttgaacaatgagaacacatggatacagagaggggaatatcacacaccagggcttgtcagggggtgggggcctcggggaggaatagcattgggagaaatatctaaagttgatggcgggttgatgggtggagaaaagcaccatggcatgtgtatacctatgtaacaaatctgcttgttctgtacattactccagaacttagatcataataaaaaaacacccagaattctcccttttttcatttcaaacatgttgtcttacatttctaaatatatcttcaatatgttaccttttattctacctccatattagtattacaatatttaattctctctctggcatttgatggctttagctctcattcctttaaagaaagttgaagtcagtggattatccatactgtataagcagtttccatattaataatcagtagtagttacacaaagtttagacagagggcattcgatgtgataatatagactgctgtatacaatattccagatttacaactcaacaattttaaatacaaacacatcacaattttttaaaatcatgtatctaatcatttgatgctatgaaaatacatgaaagtatgagaagttttcatgtttttatcctcttgacatattagacacaattacttgaagaatatctaaattattggttaacctggtattaaggaacaatttttttggagttgaaatgccttttccaaacaaatttttatttttatttatttattttaaaacttattttaaaatctatttttgtatgtgtgtgattttttatttaaaaaattattatttattttatagatatatagtaggtatagatatttgtggggtatatgagatattttgatacagacttacaatgtgtaatgatcacgttagggtaaatggggtatccagcacctcaagcaatcattatttctttgttctatgagcgttccaattttactccttcagttaatctaaaagatacaaccaattattgctgacttatagtcaccctgttatactatcaaatactagatcttattcattgtatctaattatatttttgtgcgtattaacctttctttttacttttgaatcagtaaagtcctttctctttatattgttattgccacttctgttttttaatggtagtctttgctgtctactgtaactgatttagcccaatttaagtgactttttagattagtgtactttgaaaaccaataaagttggtttggaatcaattaagaaatagtcaattggtattacaaaaacaacttcaatagtttcatctttattgtagatttattatttatttgtttttgaaatctatctttttagctacctatcttactaataattaggtaaaagttttagaaatgtaaaaaaaatgagattcttaaatctagcaataccaattgattaaatcaatggttttcatcctgtattatctgaggaacctacgttttctgaaagaacttcgtttagcaggaggagaacaactgtgaatagggcttctgctcccatgttactaaggaacaattttacttgtacatgctctcgatattggatttctgcatcagatttttttaaaacaaagcttctattgaaaaactatatattaaattaggctaaaccttttatgagagaaaaatttctgaagatatgtgtgtgcatgtgtgtgtgtatgtgtgtgtgtctgtgtgtaaatacaggcaatctcagatggatggatggatggatggacggatggatggatggatagacagatagatagacagacagacaggaagacagacatttccccttaaattacagagaatattccagttaagctgccacaagacctttcttccctgctgctgctgctgttgtgatgtattcttttctcagttttcctcatcattgtgcctcatccccacctggcactcttaatttgccttgcagttccaagttattacttggtatcattttcctgacacctgaagagcttcctttaacacatcttataatatagttctaattaaagcacattcccttaggttattttttggcctaaaaatgtcattaattcatactattttgagtgacattttttgttggatttggaattctgtgttgaagggtttttttgttttttaaagtcagcacttaaaagatattgttccattgtcttctgctttgcattgtttgagatgagaagtcagtgataaattttttattaggttttattaagattattagatatattgtttgatatttttcttcaaatctggacaattttgttattatttcttcaaacagttattctgttcttatttatctctccatcttttggaactccagttacttgaaatttttatctgtttaggtcattgagtctatgggttgttgaatctctgctcattttttccccaccattttatatctttctttcagcatagtttctactcctgtcaagtttaatggtcttttattctgcagtgtgtaatatattgttaaacaaacatagttgaggtattatatttttatctttagatgttctacttgtttcactttattagttgactttttgttatttctatactagattcttattttttagtttccatttttctcctatttttcttcagtccttagacaaattgataatgacaattttaaagtcttttacgttgatcatataatctctatgatttctttccttactggttttctttgagtcatttttatcctattggccacagtttcccacaaattttttccatatttaatcatgtttattgaattttggacattgtattattactttattttgtattcttccagatttttccctgtattccaattatttatgtaaataagatattgtagtagcaattactcattcatggccagaaaacctatatgctttttaaaaaataaattctacttggcttgtaacataaaataaatatgctatttttaaacgaaaaattccacatggcttataataatggaatgaacagtttccagtaccaaacccttactattaccctgattccctactcaaaaaaattttcatactatttcataaatttattctgttattgactttcaagtttctaagtaatatgttcatattgttgtgtattaccttttaaatttaacacatttttacttggcttagcgtttatgcttcaatgattgcccaactttacagatataaatccctctttttgttattcaaatactatgaacacttattaattttaatcttttaaacatttacagtctctccactatcatgtttaaaatttactttattgctctcctatggtgaatctactctaaactgaattctatatgttactcaggcttagtttattcatttattgatatattcattgataatataatcaaatttcattagtaccagcttcaaaatgactggagtatttgaaagctaataaataatataaggctgatgtaatttagtcctatacttttttagccacaagctaaaagtcgaaagaatgtgagtgatattatggtgagtaaattaatgactttaataaattacacgtgggccataaaggagaaaacagaaaaataaagaagtaggatattccatgctatgaatatttattaaatgcctactaagtatttattagtttctcataaatcattccaaggcttgggaacttggaaaataatagatcaagaaaaagagagaaattggtaggaagtgctgattctaaggccatatggatgaacttggatgttaatgtagtgtttctgatgtttagttgttatatagactaagaaaaaattggatggtaattatttgttgtctataaggccaactatcacatgttagtctataaatatcttaaatgtgggactttagcaacttagtgacaaaacaactatataaatataggaatactttagttcacaaaatttggtgatacttaaatcaattttattttactttgatctattcaccaagtcatatgcactttgtaatatttatgtggttcaagtggacatagtctacatgtagaagtaaactagaaagtgggttaagtcaaattccccatacaaatataaaatttatacatggatttaacaactatttactaagcacatactcggtagtaagcacagggtcaccatatatggttatgcaaattgttcattgacaaagaaagtctagctgataaagtggagtagagcctgaaaattaatcgacattttttccccaagctgtctgctcagaaaaggtgtgctttaaaaaatctgtaaacctagagggtttactttttctaattcaaacaaaatcaccatatagcatatgtggggctaggtgttggtgcaatatcatgttagtagaaacccagataaagttcagtttaaggaaatagactgatagatttctgtttctgataacagcacagtaacttgttggagaccaagtctcttattaatatgactagatataattcatataaaattatatttacaggctatagggaactaccacggaagcaaggacttgaggggccaatatctcagagagaaggaaagtacaaagtgttgatcttgacatttcctcttatattttgaatttacaagtggcagatgaaatttgcagaagctgaataggaacttctataagttttgtggttgaggtgaagtattgaaactcaggggcaaataatcattttctctggaggattggaatgacaaaattacaggacaacatttgaagctatgtttctaaagttttcaggtcagcaaggtttcaaagcagccgaaagtttattccatggatatttgcatcagtgtttttgttggttattatttcttcactgcagaaactggcaaagaatgtctctggacaatggaaccagaaaagcctgagcacaattttgtctgtttctctccagtttactctctcagcaagaacagacatgctcttttccacagtacaatctctacagcacctaccccatcctcagacattcacacacataatttcaatgcagctatctgtatactaatttcccatgatttctttattgtttaacagctttattgaggtaaacttcacatatcatatataatttatctatttaaaaatacaattcagggttttaatatgttcacagagttattcaaccattactacaattaattttagaataatttgtcaccccaaaaagaaacaccttacctgttagtagtttgtctctattatttcttcaatgctagggaattactaatattacattctatcctcatagatttacctattgtggatatgttacacatcctatgtgattggcttctttaatttagtataattttcttaacatttctctatgttgtaacatgtatcagtatttcaccccttttaattgccgaataacattccattgcatggatatatcatattttatctatacatcgcttgattcgcctttgggttgtttccatttttggctagtgtgaatactcctgctatgatgtttcatgtacagatttgtgtgtggacatatttgcatttattttgagaattatgagtcatccaataaattttctttatacatttgtgtgatatatttgggttcatgtttcccgactatactgaaatataactacttcagtataaattttgaggagggagctagtagctaggggctaattcttcacactgattttgggaaatcaatacatcaaaactacctttaattgaaaacatcctaaatgtccatctacaagatcttacccaaataaaatgctgtacaactacatgctgtgaattggagtagaaatatgtccataatggacatatggagtgtgcagtagatgccgtggtatccatccagatctccctctaggagtaaaggattttcatcctcctttcactattggaagtgatgctggcaagttgactttacatttgaacattctttgggaagtactttagcccaagaatgtgggatcatctaagtttactcccattttctgggggaagtttacattcaacaatgggtcaaaaagggacaataacagcctgaacccatcaccctaacttttgacagctcttaatggtcagtccagctacaaacttgacatgggattgttcagagcctttgggactcctccctaactcattctagcaaaccagcatcagcctaataccaaaatctggcaaagacacgacaaagaatggaaacttcaggccaatatccctgatgaacatagaagcaagaattcttaacaaaatactaacaaactgaatccagtagcagatcaaaaagttaattcaccatgatgaggtaggctttatttttgggatgcaaagttggttcaacatatgcaaatcaataaatgtgattcactgcataaacagaattaaaagcaaaaatcaaataatcattgtgacagatgcataaaaaagtttctcataaaagccaacatgccttcatggtaaaaaccttcaacgaactaggcattgaagaaacatacctcagaatatgagccatttatgacaattccatagccaacaatatactgaatgggcaaaagctttccccttgagaacttaaaaagacaaggatgcccctcacatcaccccattcaatagtactggaagttccagccacagtaatcaggcaacagaaataaattaaatgcatccaaaataggaaaataagtcaaacgatctttcttcaatgtgatgggactgtatatttagaaaaccataaagactctgccaaaaggctactggacctgatacataattttagcaagatttcaggatacaaaatcaatgtataaaaatcggtatatttctatgtatcaataacatccaggctgagagtcaaatcaagaatgtaatcttgtttacagtaaccacaaagaaaatgaaatacctaggaatacagctaaccaaataggtgaaagaccacacaaagagaactacaaaacactgccgaaagaaatcagagatgacacaaatgaatggaaaaatgttccatgctcatgggttggaggaattaatatcactgaaattgcccaaagaaacttaaagatttgatgttattcctatcgaactaccaaagtcattcttcacagcattagaaaaaagctattctaaaagaacaaaccaggaatcccaagaagacccacagaccctctgaaggaagtggagtgctcctgcaggaccctggagatatctcaaatactgtgctggtatccacagctgagagaccacagatggttaatatcacaggactctgtgcagacaaccccctggagccgggtaggcttgctgtgtagctagatccagaagagagataacaatcattgcatcttggctcacagaaagccacattcataggaaaagggggagagaactgcatcaagggaacaccctgtgggacaaaagaatcggaacaacagcctttagccctagacctttcctctgacagagcctacccaaatgaaaaggaactagataaccaactctggtaatatgataaaacaaggctctttaacacctcccaaaaagtctcactagttcaccagaaatagttccaacctaagaagaaatctctgatttacctgaaaaagaattcaggaggtaagttattaagctaatcagggaggcaccagagaaaggtgaagcccagtgcaaggaaatccaaaaaacaatacaagaagtgaagggagaaatattcagggaaatagatagcataaaggaaaaacaaaccttcaggaaacactggacacacttacaaaaatgcaaaattctctggaaagtctcagcaatataattgaacaagtagaataaagaaattcagagcttgaagacaaggtttttgaactaaatctaaaaaagacaaagaaaaaaataagaaaacatgaaaagtctccaaaaagtctgggattatattaaatgaacaaacctaagaataattggtattcctaaggaagaagagaaatctaaaagtttggaaaacatatttgggggaataattaaggaaaacttccctggccttgttagagacctagacatccaaatacaagaagcacaaggaacacctgggaaattcatcataaaaagctcattgcctaggcatattgtcatcatgaagaaggaattaatgaaataaactataacctaatagtagtagtaatagaaatttaaaacttaaagtttctgcaaagtgtgacccccttcccccacttacactcaagttaaaagagaatattaacagcctgtcttctctctgtggtcagtggacctcatctatactcctcaactccacattcctcaaagtttattacaggcccagcgtaataaactgcttacctccctagcatgcctgcagggtcacaagaccaataagtttaggtcgcaagacatgtttctctcaagatgtaagaaatgttgtaatgctgcctttgtttcttccttctgtaacttgcttcccatctcacatagttgctgctttaagatgtttaaaagtaggaaaagccttttgtttggggctcagactttctggacaaatgtctggctgagccagttatcaccttaatttgataaactctcctgaaccttttttggtctctccagtctttgattgtcctgtaccatttctgggggcccatctgggattggagatggcagattttctgtctcctttacctgtggactacagctccaggatgtgggagacttggggtccttggcactgccaggagagtttcagcctggaaggagaatggccctcctgcattctggagccttcccccaacagcacaaatggaaccagtagaaagggttgcaggatggtcacgggagcatgtgcagacatctgaaccacagtaaggtttgggccctaaggcaagacccatcccataaagacagaaggggagcttgatcacatcccagggcatgatgactagtccaacccgagggggttgggaacactgggagaggcccactgactcggacaaaattcacaccctaactgacaccagatgtggatggggcccacgagtcagaaaggaaaaccgtttcagggacggaggaggtgtgtgaaagtgtgtggaagagagtctcgggagagaccatcatggggcgtgatgtggggaggcacggatctcttagtgtggactatgtgctctgaggtgaatgtgggaaaaaccagatctaggacactgtatacagcccataggaccagctccacagctgcagctagctgtgacaggaattaaggcatgctcctggctaagcagtgtttgaacctcccataataggacccagtctggtggatccaagagtgaaagtgagagtgaaagcacctcgcaagggaggaaatgggaggaaaagtatcaaagcctactccactggggtgcatgctgaaaaattttaagaaaggttttaatgatattgggttatgctaactccacagaaactgaggaccctttgtgagatagaccggccatcttttaatgtagggtagctggctgaagggacaatagacagggaaataatgggccaagtgttccgggtagtcaccggggttggagaacagcctgggcacccagatcagtttccatatattgactcctggctaagtataattcaaaaccaccctaagtggctgcaggcctgctttgagacctactgtaagactctaatggcccagataaaaccaggaaccatagaaagagattgcaaggcatcagtaaaagaaaaggattcacaggaaaagcagaaaaaacccgtcctacaggccccacctgaagagttagaaagtccagccctctatgcaccaatttatccatccctggcaaggcttagacaggaagctgccccagctgcccccagaggttcagattcagaagaaagcacccctcaggcaacaccatgcagagaggagccagagcccttgcctgaaaagtgaagggaggaactccagggggatgaggtcagccgccttaggtcaggccatgcccaagcaatgcagatccccctccaagaaacatgggaacaaatttatttgaatgcacagaatgaagtccaagggggagaatggctcttaatttatcagcccttctctactactgatctcttaaattggagacaacatactccctcttatacagggaaacctcaagctcttatagatctaatgcagtccatttcctaattcacaatcctacctgggctgattgcaaacaacttcttcagtcattatttaatacagaagagcaccatagagttatacaagctgccttccagtggctggagaacaatgcacctgcaggtacaggatatatcaggcagtatgcacaacaagcactcccaatagaggctgacacaggctgggaccctaaccaggctcaagggctacaaagcttgcagtggtatcgagaggcactcctaaatggaataaaggctggagggaagaaggccaccaatattggaaaagtctcagaggtctgccagaagccagatgaaagtcccagtgaattttatgagaggctgtgcgaggcttaccagctttacacaccatttgacccagaggctgcgggtaatcagtgtatggttaatgtggcatttgtaagccaggcacaaggagacataaagcgaaagcttcagaagttagaaggttttgaaggcacctaaataacccaggttatctatgtggctactaatgtatttgtaaattgggatgaggaggccaagagagaagccagacacagagctaaggaaaaggcagacttgctggtggcagccttagttggaaaagaaactggttttgtgagaagatgtggttgtggtcatggtcgtggtagaggacaagctaggtaaaactaggtagctaagccaggacaagagctgacctaggcctgagagagatcaatgtgtgagatgcaagcagatgggacactgaagaatgaatgcccacaaagagaaaaggataaaggcaacaatcagggacaaaatggctggccagaaccccctactgctggtcaagggattcagaaatcagacatggatttaatcggactggcaggaatcaattattattatgaggactgagacagaccaggctccatttcattaggccccgaggagcctatggtctcaatggaggtaggaggctggaaaaaggactttatggtccatactggtgtggagcactcggtagtaaatcaagcaatttggctattgtctaaaaattatgtcaatataattggagctacaggaataacagaaaagaggccttatttcaaatctaaaatatgtgtccaacatgaatttttatatttgccaaattgtctggtgcccttgttaggaagagatttgctccagaaattgcaagcacaaatctcctttacactagaaggggacatgactctaaacctaggtcaaagaaaagccatcataatgacgcttactgtcccaacaacagaggaatggagactctatgagagatgcaaaatttgtaaagatgcattttgccagtgggaaaatgaggcaatgtataaggaattatttctcaagctgccaggggtcttggtggaagacaatcccccggggctagccataaatcaggcacccgtagtggtggaactgctgtggggcacttacccagtgtgaatctgtcacaatcccattccagcagaagccacccatgggattactaagcatatagaccagttccttaaatttgggataatagaaagatgtgcctcttcttggaacactccattgctaccggtgttaaagccccccggagattaccagccggtacaggatttatgggcagtaaataaggttgcagctacattatatgccattgtgtccaacccatatacaatgcttgggcgaattcctgctgatggtgcttggtttacatgcttatacataaaggatgcattcttctgcatccaactagctcctgaaagcatctttgcctttgagtggggcttatcacagtatacttggaccagactccaccaaggattgaaaaactccccaaccattttcaaggaagcactagcccagacctgaaggctttcatgccaccaagtgaccgccgtgtcctgttgcagtatatagatgatttattgttagctgcacccacaaaagaagagtgctttcaaggcacagaaagcttccttcgtgttctgtgggaggctggctataaggtgtctaaggaaaaggcacaaatctgtggccaaagagcaaggtatcttggctttaacatctctcaagggcagcgtgagctcggacatgagtgaaaagagactgtgtgtggcattcctcaacctggcactggacaacaagtgtgggagtttttaggggcagctggtttgtctcacatttggattccaaattacacactcggcaaaaccattgtatgagactaccaaagggaggggggaaagaacccctcctgtggggaaaagagcaggacacggccttcaaagaaatcaagaaggccttgatccaggtcccagcattggaactgccagacatgacaaggcctttttacctgtatgtccatgaaagaaaaggaatagctacaggagtcttggtacaaaaactagggtcatgatatcagcccatggcatatttgttcaagtgactagacttggtggctatgggatggcattggcagccactgccctgttagcgcaagatgctaacaagctcacatttggacaaaggttaataatttgcgtgccccacatggtcatcaccctgttggagcagagggggtatcgcttgctttctaaccctaggatgttaagatatcaaggacttttttgtgaaaacccctatataaccttagagactgtgaataatctaaatccagccacactgctgccaatacagtgggtggagcatggaaagcccccattgtgtggcccagggtatcactgttgtgtggaaacagtggatgaggttttctcaagctaaaaagacttaaaggaccagcccttaaaataccaagatgttgaatactttactgatgaaagcagcttcatatctgaaggtgtcagatgggctggatatgcagtggtaacactgaattcagtagctgaagcctgccctctgctggtcggaacttcggcccaaagagctgagctaatagctctcactagaacgttgctcttggccaaaggaaagtcagtaagcatctatactgactcaaggtatgtttttgccatttgcatgcccatggagccatatacaaggaaagaggattattaactactgaaggaaaggaaatcaaaaatgaaaaggaaatagagcagctcttagaagccatatgggctccaaaagaagtagcagtcatctattgcaaagggcatcaaacaggagggcgtgacgaggctagaggaaacagaaaggcgacagagaagccaaaagagctgcaatgacagaggtaactaagaaggaagaggaaacccttaccatgcccttactggagcttcccctaacagaacccactaactactcctctaatgaaaaggcatttgagcaggacagtggaagttaccagaaaggaggttggtggaagttctcagatgggaggctcgccttccaatagcccccccgcccgcccagttcataaaagtttcatcaaggaatgcatatgggaaaaactgcattagagactcttgtaggacagcatttctatgtgctgcacctaactgccatcgctcaagccatttgtgagcaatgtttaacttgtgcccaaaacaatccatggcaggggccaacatggcccccagggattcaagaaactggagctacaccgtgtgaaaacctgcttgtggactttaccaagctgcctcaagccagaggctactggtacatgctagtgtttgccttcactttctcagggtgggttgaggcatttcccaccaggacagagaaagctcaggaagtaaccaagatcttactaaaggacattatttctagattttgactgactctaacattaggatcagacagtggcccagtgtttgtggtagagatagtacaacagctaacgcagatgttaaaaatcaaatggaaactgcatacagcttatcacctacagggttctggaagagttgaaagaatgaactggacactcaaacagctgttaaagaagttttgtcaagaaactcatctaaggtgagatcaggtgctgcccgtggtccttctccatgtcaggtgcacccctactaaattaaccgggtattcaccctgtgagatagtgttcggctgaccaccctcaatcataattcagataaaaggggatttaaaataaattggggaattaaccttaagaaggcaaatgcaagccttaagtgagaccatgtagtaaatacaagggtgggtaaggaaaagaatacctgttagtctcacagatgcagtatatcccttccaacctggagactctgtctgggtcaaatgatggaacccaaccaccttagggcctttatcggatggtccccatattgtgatcttgtctacctcactgctgttgaagttgcaggtatcacaccttgggttcatcatagccagctaaaaccagcagtgaccacaactcaggaccagtggaccagtcaataaaacccagaccacctgacacggctgatcctgtggtgagaccaagccactactgacaagggcaactgccctgctccatccacactggaggctggtcggtccacgcacagctgaagcttaaggaaacatcaagccctgctctagtcacacaactggaagctgactagtctacacatggccgaagcctaaggaaatcaatgatagataagtaaatgtggattgaatttacaagcatagttatactcttacttgtactgattattttactgtcatgttgtctttgcaaatgttgccaagcttgttgcccagaagggtgcttatgcatagtatgagtttaatcatattagtaatactaaagccatttatactttcacctatggttataaaaggggactaggatgactgtcatcactgtatagtagaagcctggtccagaaaaggtgtgactaaaactctgttataccagacctactatgagtatacagagactcatacaggaacttgtgtctataaccagactagttactcagtctgtgatcctggaaacaggcagcccaagaatgttatgaccagagttcttgccttatgacttctggtttgaagtccaaattggtgaacccctaatgctatcatatacaaaccccacagaaactggggtcggcaaacttgtaaacaaaatggaagtattcccttactcaaataaagggcctatctccatatattttgattgctgccaagctgcacatcccagtaaactaaataatattgggaccatctgtaaaactctaggacaagaaaaagtcagcagcagagccaccaaggccgtaatagaagagtccaaaaaagagtgccctgattgttaaaatcagtggaccatgatgaatttaatcagcaactatacacaggaagggttgctctgtttgccagccaagaagtgaagatagggtgcacaactggaacatgcaacccactcaatctgacagtactaaagccaaatatgcctttctggactaaaatggataagggctactaacctttgatcaggcaggagctctcctaggacttggtattcctctggtcatcacgaagaaaacccaaaggacccaagtttaagttaccccaatgcaacagtttaggttttataaatctttcaaggaacactttaatcctgaagtatcaaaaattcaaattcctcctatatcagttgaaaatgtgtttacccagctagccaaaagtattgctaacaatttcggagttacttcatgttatgtatgtggaggtactaatctgggaggtcaatggccctgggaagccaaagaattgatgccgcaagacaattttaccttgcccgaatttgctacaaaattcagtgcaaatccaagtgtttagctattaaggaaccccatcatcggaaaatactgtatcgcctgacaaggcctttcagaaccaggtaggggaaacaacttgcctaggtcaacaatattttgaagaatccaagaacataacacaatgaagaagctttatagacaattcctctgtgtcagactgtaatccttttttgctgttcccaacattaaatcaatcatagtaccaattagatgctccaactgtttggagagcacctgcagggttatattggatctgtggaacaaaggcttatcaattactacctgataaatggacaggggcatgtgtattaggaaaaataaggccatcctttttcctactcccactgcagcaaggggaagatctaagctatccgggctatgatgaaggtggaaaaagaatcagaagaaatgtgtttacaaaaataagtactgtggaaaaaataaatactaacattaaaaaggacattgaaatagggagctggaaagataatgaatggccccctgaaagaattatcaaatactatggactggccagctgggcacaagatgggtcatgaggatgctgtactcttatttatatgttaaaccacatcataaggttgcaagcagttctggagattatagtcagtgaaacagcccgagccttagacttgctagccatacaggcaacccagaggagagatgttatttatcagaacaggttagcactggattatcttttagcttcagaaggaagagtttgtggaaagcttaattcaatgaattgctgcttacaaattgatgacaatggaaaagctgtcatggaaatcactgccaggaagcagaagttagctcatgttccagtccagatgtggtctggctggaacccaagttcactctttggaggatggttttcatggtttggaggctttaaaactttaataataggctttgtggccataataggtgtatgcctaatggttccctgtctcctgacacttctcatcagaagcatctaatccaccatagaagcaatagtagacagacatatcaccacccgaataatggttctgcaaaagtaccaactggtatcccaagatgagtatgtacccactcaagaagaaatagctaactgtagtgctctttactaatctacatttgtgtcgagcacaaaggggggaataaagaaggaattaatgaaatcaactataacctactagtagtagtaacagaaattttaaaatcctcataaagttgctgcaaagtgtgactccccccaccccccctcccgacttacactcaagttaaaagagaatattaacagcctatcttctctctgcggtcagtagaccttatctatactccccaactccacattcctcaaagtttattacaggcccagcgagtttctgcttacctccctagcgtgcctgcagggtcacaagactgaaaagttttggttgcaagacatatttctctcaagatgtaaagaaatgttgtaatgctgcctttgtttcttgcttctgtaactcgcttcctgtctcacgtagttcccaccttaagatgtttaaaagtaggaaaagccctttgtttggggctcagactttctggacgtatgtccggctgagccagttatcacttcaatttaataaattctcccgaacctttttcagtctctccagtctttgattgtcccgcaacaatcaggttatccaaagttaagacaaaggaaagaatcttaagagctgtgagacaaaagcaccaggtgacctataaaggaaaacctatcagattaacagcagatttctcagcagaaactctacaacctagagtagattgaggccctatcttcagtttcctcaaacaaaatgattatcagccaataatttttgtatccagcaaaactaagtatcatgtatgaagaaacaatacagtatttttcagacaaacaaatgaggagacaattcatcactaccaagccaccactacaagaactgctaaaatgagctctatgtcttgaaacaaatcctggaaacacatcaaaatagaaattctttaaagcataaatcacacatgacgtataaaatgagaatacaagtgaaacagaaaaaaaataggtacacaggcaacaaatagcaggatgaatgcaaaggtacctcacatctcaatactaacattgaatgtaaatggcctaaatgttccacttaaaagatgcagaactgcagaagggatagaactcaccaaacaactacctgctgccttcaggagactcacctaacacaaaaagactcacataaacttaaaggtgtaggaaaaggaatttcatgcaaatagacgccaaaagccagcagagtagctattcttataacagagaaaacaaacttcaaagaaacagcagttaaaagacacaaagagggacattatataaagggccttgtccaacaggaaaatgtcacaatccttaacatacatgcaccgaacactggagctcccaaatttataaaacaattactaataggtctaagaaaagagatagacagcaacacaataattgtgggggacttaaatactccactgacagccctagacaggtcatcaagacagaaagtcaacaaagaaacaatggatttaaattataccttagaacaaatggacttaatagatatatacagaacattttattcaacaagcgcagaatacacattctattcaacagcgcatggaactttctccaaggtagaccatatgataggtcataaaatgagcctcaacaaatttaagaaaattgaaattatatgaagcactctctcagatcacagtggaataaaactggaaatgaactctgaaaggaacttttgaaactatgcaaatacatggaaattaaataacctgcttctgaatgaacactgggtcaaaaacgaagacaagatggaaatttaaaaattcttcaaactgaacgacaatgacgacacaacctaccaaaacctctgcaatacagcaaaggcagtgctaagaggaaagttcatagccctaaacacctacatcaaaaaggctgaaagagcacaaactgacattctaaggtcacacctcaaggaactaaagaaacaagaacaaaccaaatccaaagccagcagaagaaaggatgtaacaaagatcagggcagaactaaatgaaattgaaacaacaacaacaaaaatacaaaagataaatgaaacaaaaagctggttctttgaaaagataaatacaattaatagaccattagcaagattaaccaagaaaagtagagagaaacttcaaataacctcattaagaaaagaaatgggagatactacaacagacaccactgaaatacaaaagatcattcaaggctactatgaacacctttatgcacataaactagaaaacctagaagagatgaataaattcctggaaaaatacaatgctcctagcttaaatcaggaagaattacataccctgaacagaccaataagaaacagtgagattgaggtggtaattaaaaaattaccaacaaaaaaattccaggacaagatggattcagagcagaatcctaccagatattcaaagaagcattggtaacaatccttttaacattattccacaagatagagaaagagggaaccctccctaattcattccatgaagccagcatcatcttaatcccaaaaccaggaaaggacataaccaaaaaagaaaactacagaccaatatccctgacgaatacagatactaaaatccttaacaaaatactagccaactgaatccaacatcatatcaaaaagataatccaccatgatcaagtgggtttcataccagggatgcaggggtggtttaacatacacaagtcaataaatgtgatacaccatatacatggaattaaaaagaaacatcacatgatcatctcaatagatgcagagaaagtatttggcaaaattcagtattgctttatgattaaaactatcagcaaaatcagcatacaagggacacaccttagtgtaataaaagccatttatgacaaacccacagtcaacataatactggatggggaaaagttgaaaacattctctctgagaactggaacaagacaaggatacccactctcacctctcctcttcaacatagtactgaaagttttaggcagagcagtcagacaagagaaggaaataaagggcatccaaataggtaaagaggaagtcaaactgtcactgtttgctgacaatatgattgtttacctcgaaaaccctaaagactcctccagaaagctcctagaactgatgaagaattcagcaaagtttctggatacaagattagtttacacaaatcagtagctctgttgtacaccaacagcgaccaagcaaagaatcaaatcaagaagtctaccccttttacaacagctgcagaaagaaaaaaaaaacttaggaatatacctaaccaaggaggtgaaaaacctcctcaaggaaaactacaaaacactactgaaagaaatcgtagacaacacaaacaaatggaaatgcatcctaagctcatggatgggtagagtagaatcaatatttggaaaatgaccatactgctaaaggcaatctacaaattcaatgcaatccccatcaaaataccaccatcacttaacataatttgaaaaaacaattctaaaattcatatggaaccaaaaaagagcccacatagccaaagcaagactgaggaaaaataacaactctggaagcatcatgctacctgatttcaaactatactataaggccatactcactgaaacagcatggtactagtatcaacataggcacatagaccaatggaacagaatagacaacccagaaataaactcaaatacttacagccaactgatcttcaacaaagcaaacaaaaacataaagcagggaaaggacaccctttttaacaaatggtgctgagataattggctagccacatataggagaatgaaactggatcctcatctcccacattatacaaaaaatcagctcaagatggattaaggacttaaatctaagacctgaaactataaaaattctagaagataacattggaaaaacccttctagacattggcttaggcaagaatttcatgaccaagtacccaaaagcaaatgcaataaaaacaaagataaataattgggacttaattaaactaaagagcttttgcaagaggaacagtcagcagagtaaacagacaacccacagagtgggagaaaatcttcacaatgtatatatctgacaaaggactaatatccagaatctacaatgaactcaaacatatcagtaagaaaaaaaaagcaatcccatcaaaagtgggttaaggacataaatagacaattctcaaaataagatatataaatggccaacaaacatgaaaaaatgctcaacatcactaatgatcagggtaatgcaaattaaaaccacactgtgttatcaccttactcctgcaagtatggtcataataaaaaaattcaaaaaacagtggatgttggagtgatgtgatgatcagggaacacttctacacactgctggtgggaatgtaaactagtacagccactgtggaaaacagtgtggagattctttaaagaacgaaaagtagaactaccatttgatccggcaatcccactactgggtatctgcccagaggaaaagaagtcattatacaaaagatatacttgcacacgcgtgtttactgcagcacaattggatggaatactactcagccataaaaaggaatgaattatggcatttgcagcgacctggatgagattggagactattattttaagtgaagtaactcaggaatggaaaaccaaacatatgttctcactgataagtgggagctaaactgtgaggacacaaaggcataggaatgatacagtggactttggggacctggcgagaagggaaggaggtgggcaaggaatacacgactacaagttggattcagtgaatacttctcgggttgtaggtccaccaaaatctcacaaatcaccactaaagaacttactcatctcatcaaatatcacttgtaccccaataatctatgaaaaaaaatgtttaaattagcatacaaataaaaacgtatgcacatttaacaatttaaataggttttgcctatttttcagccctgtagaagtatatgaaagagccctatcctctgaaagtttagaagtaaaaaagtgtgtgtgtgtaaaaaaaaaaagaaagaaagaaaaagagtattctaaaattcatacagaatcaaaaaagaagccaaatagccaaatcaattctaagcaaaaaaatgaagccagaggcatcacactacctgacttcaaactgtattgtgaggctatagtaaacaaaatagcatgacactagtacaaaaacagacacaaagaccaatggaaaagaatagaaaactcatgaataaagcttcacacctacaaccaactgatttttaacaagaccaacaaaaatgagcaatggagaaagatgtccatattcaataaatggtgctgggataactggctagccatgtgcagaagaatggaactggacccttacctttcactgtatacaacaattaagtcaaaatggattaaagatttaaatataagacctgaaactacaagaatcctagaagaaaaccgtaaatatccttctggacatcaaccttggcaaagaatttatggccaagtccccaaaagcaattgcaacaaaaccaaaaactgataagtgaggcctaattatactaaagagcttctgcatgacaaacaaaatgataaacaaagtaaatagcctacagaatgggagaaaatatttacaaactatacatctgacaatggtctaatatccagaatctatcaataacttaaagaaatcaacaagcaataatcaaataacaccattaaaatgtgggcaaaagacataaacagacacttctcaaaagaagacataaatggccaacaaacatctgaaaaaatgctcattgtcactaatcatcagagaaacgcaaatccaaaccacaacgagataccagctcacaccattcagaatgccaattataaaaaatcgaaaacaacacatgctggcaagactgcagagaaaagggaatgcttataaactgttggtgggaatggttcaaccaccccaccccaaagaagtttggagatttctcagagaacttagagctaccattcaacccagcaatcccattactggccatatatccaaaggaatatagtcattataccaaaaagacacattgaatcatatgttcattgtcacaatagcaaagacattaaatcaatatgagtgcccattaatggtggattggataaataaaatgctgtacatatagaccatggaatattacatggccataaaaaagaatgaaatcatgtcctttgcagcagcatggatatggctggaggccataagcctaaatgaattaatgctagaacccaaagccaaatactcatgttctcacttataagtgggaggtaagtattgagcaaccatggacataaatatgagaacaacaggcgctatggactactagagggaggaggatgagaggagtacatgggtggaaaaactacccattgggtactatgctcactagctggctcccctacacccatgtaacaatcctaattctcacatttaccccctctttattgtaactaaaagctgaaattttttaaaaaatgactgcatgtcatcccaactactcccactatccaatcctacttccttcctttcctttatctttcatagatggtgtttccaaagcattctctaaccacttgcccattaatctctatgtcagtgtctcctttccatagaactcaatctgcaacagaatggtcaccatgatacactcataactaagaaaagcaaaatgaataaaagaataccgaatgtgatattatttaataatggaggaacatatgtgcttgcatgtgtttttgatatttaacaacaaataagtaaaccataaaatatggttacttataagaggaggagggaaatgggtggaggtcacaatagaaactagatttcttaaaacagatctttagatatggatttgcatttaaaaccatgtaaaaatattgtatatagtataattatagcatagttatagaatgaaataaaatttaaaatgtaaaaatcagaagtaaaataaatgatcctgtgtcattcattggtggtacaaaaacgcataaaatgtctattccaatgttttaaaaatatagtaatttgggcacacatctctagtgggttcttaaggacagaaagaaccacccaaaaatgttaagggcagccggagagaaaggtcgggttacccacaaagggaagcccatcagactaacagctgatctctccacagaaactctacaagccagaagagagtgggggccaatactcaacattcttaaagaaaagaattttcaacctagaatttcatatccagacaaactaagcttcataagtgaaggagaaataaaatactttacaaacaagcaaatgctgagagattttgtcaccaccagtcctgccctaaaagagctcctgaaggaagcactaaacatggaaaggaacaaccggtaccagccactgcagaaacatgccaaattgtaaagaccataaaggctaggaagaaactgcatcaactaacgagcaaaataagcagctaacatcataatgacaggatcaaattcacacataacaatactaaccttaaatgtaaatgggataaatgctccaattaaaaggcaaattggataaagagtcaaaacccatcagtgtgctgtattcaggaaacccatctcacgtgcagagacacacatagactcaaaataaagggatggaggaagatctaccaagcaaatggaaaacaaaaaaaggcaggggttgcaatcctagtcttggataaaacagactttaaaccaacaaacatcaaaagagacaaagaaggccattacataatggtaaagggatcaattcaacaagaagaactaactatcctaaatatatatgcacccaatacaggagcacccagattcataaagcaagtacttagttacctacaaagagacttagactcccacacaataataatgggagactttaacaccccactgtcaacattagacagataaatgagacagaaagttaacaacaatacccaggaattgaactcagctctgcaccaagcggacctaatagacatctacagaactctccaccccaaatcaacagaatatacattttttttcagcaccacaccacacctattccaaaattgaccacatagttggaagtaaagctctcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactggatacataatgaaatgaaggcagaaataaagatgttctttgaaaccaacgagaacaaagacacaacataccagaatctctgggacacattcaaagcagtgtgtagagggaaatttataccactaaatgcccacaagagaaagcaagaaagatctaaaatggacaccctaccatcacaattaaaagaactggagaagcaagagcaaacacattcaaaagctagcagaaggcaagaagtaactaagatcgagcagaactgaaggaaatagagacataaaaaacccttcaaaaaatcagtgaatccagcagctggttttttgaaaagatcaacaaaattgatagactgctagccagactaataaagaagaaaagagagaagaatcaaatagacgcaataaaaaatgataaaggggatatcaccactgatcccacagaaatacaaactacatcagagaatactataaacacctctactcaaataaactagaaaatctagaagaaatggataaattcctggacacatacacactcccaagactaaaccaggaagaagttgaatctctgaatagaccaataacaggctctgaaattgaggcaataattaatagcttaccaaccaaaaaaaagtccaggacaagatggattcacagccgaattctaccagaggtataaggaggagctggtagcattccttctgaaactattccaatcaatagaaaaagagggaatcctccctaactcatttcatgaggccagcatcatcctgataccaaagcctggcagagacacaaccaaaaaagaggattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgaaaatcaataaacgtaatccagcatataaacagaaccaaagacaaaaaccacatgattatctcaatagatgcagaaaaggcctttgacaaaattcaacaactcttcatgctaaaaactctcaatattgatgggatgtatctcaaaataataagagctatctatgacaaacccacagccaatatcatactgaatggacaaaaactggaaacattctttttgaaaactggcacaagacggggatgccctctctcaccactcctattcaacatagtgttggaagttctggccagggcaatcaggcaggagaaggaaacaaagggcattcaattaggaaaagaggaagtcaaattgtccctatttgcagatgacatgattttatatctagaaaaccccatggtctcagcccaaaatctctttaagctgataagcaacttcagcaaaatctcagcatacaaaatcaatgtgcaaaaatcacaagcactcctatacaccaataacagacaaacagagagccaaatcatgagtgaactcccattcataattgcttcaaagagaataaaatacctaggaatccaacttacaaggtatgtgaaggacctcttcaaggagaactacaaaccgctgctcaatgaaatcaaagaggatacaaacaaatggaagaacattccatgctcatgggtaggaagactcaatatcgtgaaaatggccatactgcccaaagtaatttatagattcaatgccatccccatcaagctaccaatgactttcttcacagaattggaaaaaaactactttaaagttcatatggaaccaaaaaagagcccacattgccaagtcaatgctaagccaaaagaacaaagccagaggcatcatgctacctgacttcaaactatactatgaggctacagtaaccaaaacagcatggtactggtaccaaaacagagatgtagaccaatggaacagaacagagccctcagaaataatgctgcatatctacaactatctgatctttgacaaacctcacaaaaacaagcaatgggaaaaggattccctatttaataaatggtgctgggaaaactggctagccatatgtagaaagctgaaactggatcccttccttacaccttatacaaaaattaattcaagatggattaaagacttaaaggttagacctaaaaccataaaaaccctagaagaaaacctaggcaatatcattcaggacataggcatgggcaaggacttcatgtctaaaacaccaaaagcaatggcaacaaaagccaaaagtgacaaatgggatctaattaaactaaagagcttctgcacagcaacagaaactaccatcagagtgaacaggcaacctacagaatgggagaaaattttcgcaacctacttctctgacaaagggctaatatccagaatctacaacaaactcaaacaaatttacaagaaaaaaataaaaaaccctatcaaaaagtgggcgaaggatatgaacagacacttctcaaaagaagacatttatgcagccaaaaaacacatgaaaaaatgctcatcatcactggccatcagagaaatgcaaatcaaaaccatgatgagataccatctcacaccggttagaatggtgatcattaaaaagtcaggaaacaacaggtgctggagaggatgtggagaaataggaacacttgtacactgttggtgggactgtaaactagttcaaccattgtggaagtcagtgtggtggttcctcagggatctagaactagaaacaccatttgacccagccatcccattactgggtatctacccaaaggattataaatcatgctgctataaagacacatgcatacgtatgtttattgtggcactattcacaatagcaaagacttggaaccaacccaaatatccaacaatgatagactggattaagaaaatgtgtcacatacacaccatggaatactatgcagccataaaaaatgatgagttcatgtcctttgtagggacatggatgaagctggaaaccatcattctcagcaaactatcacaaggacaaaaaaccaaacaccacatgttctcactcttaagtgggaattgaacaatgagaacacatgggtacaggaaggggaacatcacacaccagggattgttgtggggtggggggagtggggagggatagcattaggagatatacctaatgctaaatgactagttaatgggtgcagtacaccaacatggcacatgtatacatatgtaacaaacctgcacgttgggcgcatgtaccctaaaacttaaagtataataataataaaattaaacaaaacaaaacaaaaaaacattttcagtcaatagatgtgggtagtaatgatgcagttactctagtggagacttccgttgattgtaagaaacatgaaatatgtaattataatattgtcattggcatatttggaaggaaattaatgaaaaaacctacacttctaaattttgattatatgtatcactataagctcttgatgtagtttattataaaaccaacaaaaacttttctagctttgactactaaaaatgcttaaaataatgacaatgcagtagcaagaagcagatctagattccatttataatctttaaaaactacttcacatcacattcttggagaaatatctaatcattcatgtggggacaaaaaagaaactggaaactctacagtatgaaggcactagtttcttcaaaaaaatttttgctcaaataataaaacagaggaagaacctatagatcaaatgatatttcagaagtatattaattaattacaatatatctacctgatttggtttaatttatttggtttgatttaaacaaactcttttaaaaacaaggttatgacagccaaaattgtgaaactaactagatatatgatattaagaaattattattaatccttaggctaatgcaattgaggttatacattttgaggacttcttagcttatagaaatgtgtatagaatatttacagataaaatgttctgatctttgaggtatgtttccaaaaatctgaagatggagggtgtagtatacatatgatgtattagatgaaataaatttggctgcatttttatatttgttgaagctggcagatggctatagtgggtttgtcatactactctatctacttatgcatatgtttgaagatacgcaaagaaaaaaaaactcttactataggcactccaacatgatttccactggtgtttactttgcttctttcttggcatcatgacatcccaagcagttctcaagctccagcacattggtttaaaatgccctagtttttcaaaatctccatttctccttatattttaaatgtgtttatttgtcttttccttatctacccctttcctaatacctggaaactcactcaactgtgtcgtgctatcttctttatagcacttctccttcactctcaccttgtaaactttcggcctcaacacaaaaaaattcaccttatttctgggtagaattttactctcaacctctactcactgatgaagatacacatttttgtattaaagataaagatacacatttttgtattaaagataaatcttttaacattttgttaaacgagatcttgtgtttatattttaatatttaaaattttttcttcccacatctataaccactagagtagcccaacaagacaattctggcttgctaaaagaactgattgagaaattattttaatactaatagcaataattttaaacataccaactaataactattgagcactattatgcacttctcatttgtttctcatgataaatttattatgtagattattgattctgtttactattttctatttattgtttactgtttatactactggtattctgagaagaccatgcttttctctagcatcatatttacatatgtaaggtcttcaagcaaagagataatgttggattttttttccatatcattcctgtttggaagaaagcattatgcaagctgagctcagttcttttctttctcccatggaagccactcccatggaagtaactttcagatatgtgttgaggaactctctctgaaattgccaaacactgtgcctggctgagttgaatgtttcattctgtggtaaagtattcggaagcccactagttgaagatctaaatccacaactctaactgagcaattatcaataacaaaactgacaaaagtattttcatttctctgatgccttgcaaatgttcttcagctggttctaaacttgtttgggaaaggacggatctttcaaatctttgcagttcctttatattttagaaaatgaggtattttttcaaagtcacaaacctaagacatgacatggcagcactagactcaatttcaggctattgacagcagacatcatgctctcccttacttccctatactgagaatctttacagtcttatttaccatccttttaccaataatgacatttggcattattgagttgtttgaatattacaagtgatgcttattgaaggttccttacatcctgtagttttacccagtgcttttattaggactttgaatattattatggatcatcacataaccataatgtttcaacgtggagactgaatacagtattccatgtcttgtttgcttttgatcttaaaattatataaaaatgacattaaaattagaacaaaatcttttcatcaacatcagcaaattattggaatatacgctcagttttggtataagaataactgcattgtagtattacaagaaaactttgaaaagcaatgtataatattactatcaactaaataataaaatgtgtaagcaatgtcattatcttgctatccgtattgtttaattacatataaattaatttatatgtaatacaaatgacatataatatgtattttagagatataagctctgagtaaactcttatttatttaagaggtgctaattgtatcaactcctatatgattttatcatgaacttattatttattgaaagtagcaccttatgaaaactaaaccataaattaagatgcaaaaaataaaataatacttgttttcagcctgaacaattaggaaaatgccagctaaaataaaaatttagtctgtgatattgttcaatactaggtaagagttaatgattctataaaataaatagaatcttctatttgatacaaagtgcatatttttatttaagttgaaaattctcctttgattattaaaaataaaggaatgttatttaaagtgtttttagttttgtttttcaatttaaaaatctcaaagcaaagaaactcctcaagaaaacttaaactgtctgcaatttgttaatgccctattgatagttgaatgatttctaaaataattattcaataacaatatttattgctagagcataatataagaaaaggtagatcttgtctttgccttgaactacaagagtaaaatatgtagtttttttcccgttttgaaatatctacttgaagaagtcagcaataaaaataaatggaattttaagtcaaatgcttcagatttttatttctatttatttatttttttgctaatgatagttcactaaatagaaaatgtgtttagaaataaaggagattctagtgtgttgacactagtaaccaacttgtcttccaggattcttgtaactctagattctgtattaggtgtgtcagaaaataagtcattttggcaattttacagaagtgtctctactcagagtctaataatgataacattttttgtcatacataatattcttcagatcatcgtattacttcagatccacatctataatgttggaatatagattgaacaattttagaaaaataaatatgttttagaatattttagataaatctgaaaaaaaggtaaagactttaagaatgatagtaactatgacaagcccttgcttaaaaaaagtttattttacctaattccgaatgttaaaattaatgaattgattcacaaacatttctctatattccagagtttacagtaattccttgttaacccactatccagttattgcaaataattttgatagcattttcccagactttgaaaacataaggagagagccagttgtatggatctgggcataagaggctgatctcaaccccactctcctctggcatgtcacacatctgcctacactatccctctcaagtctctcgttatctgttttggaagtgacaaggaaatagttgaaaggagaaataagtctctaagaaggattcagcgtaaagctctggaattattctgggaagatacttacatcctcaaatgccacatttgtctgtatacaagttaattcggtgtgttgaaacccagtgatatgatttggctctgtgtccccatgcaagtctcatcttgaattgtaatccaaattgtaattcccaacgtgttgtgggagggacctcgtgggaggtgattagttcatggggccctgtcccccatgctgttcttgtaatggtgaatgagttctcacggtatctgatggttttataaggggcttttcccaacttcacttggcacttgtctcctgctgccatgtgtagaaggatgtgtttgcttcgccttccaacatgattgtaagtttcctgaggcctacccagccatgtgaaactatgagtcaatgaaacctcttttttttttttttaataaattacccagcctcaggtatttcttcatagtagcgtgagaatggattaatacatccaggaaattcagttttccacacaataataaattgagtgaagattgagatactggtataacaatctactcgaattttaagttaactaagaagaagaatactgaacttagtattctgtgattcttttagtcttatttcagtctatgcaagttttatttttgtctatttaaatgtagcaaacatggaaagaattattctgacagaggtcggctaaaccaagtagtattcagagattctagaatttctgtctcccttgaattacatagttacattatgcctctatctatctatgcatccatctatctatctatcaatcatctatctacttgtatcatatttgtatttatatctatctacagatacaacatatagttgtaaatatgactatccgcctatagatagatagcttccatttatcatctatcacaatcatttaagaagagacccgagagcagaataatttctagtaaattgaaagtatttatatacaaagacaaaaaattaatatttgcttcagtggactacaaggtcatttaaaacaaataggaagaaagtctataaataattcatcaggtgattgaggatttctaggggaacaaaagccctgatattttccttctgaaaagcagtcattaaaggtgttatttttattaccacactctattaaaatgggcatatatatgacatatggtgatacaaataataccatgtatgtataatgccatgcttagttgtaattatgtgtatacatagttatcaaatcttttgattatttactatatcagggaacgaaataatacattcctgtgagctaaaatgtaggagccccattttcaagatattccttaatatgaatttttaaacttcagtcattcacaaactgccttgtaattgttgctgtagctgaatacctcctatattaatctttacttcacatgtttctttaaaacaacccaggaccaacaccactacccattctaatctttcaataagcaaaaatacttatgaaataatgagttaatgtgcatgttctttcaatgcacactaaaataaatacagaattaaaaaaataaaataaaaatctgtccatgtgctgcctaacattaccccaaacaaacctctgaactctattattttggttggtctttatctgtaaaatgagaataacaatatagtacctagttaccatttactgtgggactctagtaagttaatatacgcaaaatattttagaactataccaggcccttaagtgttcaatatacgttcactagtatctgcatcattcatcaacttatgagcaaatcttgagaaatcctgctttattcactatctctattgttttctagggttgcttctctccccactaacctatgaaacccttgtccaagtcaccaatgtttttatcacaaatgtatgcctgtcttttcgtcttaccctgcatccaactcagtgatggtatatagcaagtccttaataaatatctgttgacaagttggttgaatgagtgatttaataacttaaaatacatgggatggaaaaatgaattcaacactaacatacttgcttactcatttttaaattcctgttcttatatctatatggaagaaaaaggtacagaattgtaattattcgaagagtaataattgtttttgccccttgggaaaatataattttattgttaattttgtaattttctctccatcaaccttatcttcttgctcaactccttccaaaattgttaatttcatctaattatacagttcattctaatggtttttacctaggttctacagtgaaatttctctataattcattcaacaactatttgttgggtcttatgttcactagaaattgtgctatggactatagacagatggctgaagaagtcatatccctgccctaaagtggttaccagtatagggaagagaatacctccccctacacacacaaaataattataatgcaatatgactaggtgcttcatgaatataggaacacagaattccctatttcctgctttattcctggcatttattttaaaaatcaatgctatataatattatattggtggtattcagaagtctttctgaatagtagtctgtaaaactcagttggaaatagaaaaatttatgactttgagtccaaatgcactaggagttgaacattatacctcatttgagtcctgtagcaatcctgtgagcactaaaacatttaaaatattttagtttttaaaaatttatttctccatcattacctgtgcatcttctagattaggcatttgaaaattctgtgcatacatggcaatacagtcaacttaaaagatcttcccattacttggttgaagcagacctggtgtaatttcaagggcattaggaaaatctcaaaagcaaacaaatttttccctctgggtttgttgatgacagaaatctcaccctctgtaatttatccttatggataaaggcgtttaggttactgaagtgtaactattcctgggagaggaagcatattaaattatcaaacatttaacaacttactagaattgctttgatcagtttctttcctgagaacaagaactgatggaaagaagttaataaaagtgcagggatattgggcttgggggacaccaccaccaggaagaaagtttgaaggaagactgagggtacctgagactggcagataggaagttggccctgccaagtgggttcattgttgcctacagtctagattttccagcctgatgaggtaggggaaacatctgtgctggggctgccagaaaatatggtttattagaagtaaatttgtaaatacaaagaacagcaactggcactgtgagccaccggaggttagctgcagtaattacactggcaaaaggcttgcttgaacactgctcttgttggtggcagaaaacagtcacttgaaacagcctaaaagcactagatgctcacccaaaacaaccaaaattatagagttcagaggtttgtttctgaaaacaaaaaggtaacacgatagagtattagatatcacaatccctgatttatttgagcaaactttggcagagatgtcagatataaacaattacataatcttttctggaaaatatataaacacaatcttaattttttgttaacagataccctaattttaaaataagttccaaagtgattatttctgcaaagccaaaaaattactcccacaagcgccatcaccactattgatcattcctttttgttaaagtgttaatttttatataggacatatatgttctaatcctatatgctagtgattctgtaggtgggtaagtaaaagtgaagacagaagcttaacttcacagtttgtttcctcatccataaaaaaagaatgttaagtgttttctttctgctttcacaatccacaatacatgatataagcatctggaaaaatagccatgattttctcattttcatgtggtattctattttttccttcatttgagatgtaatagaaaattgctattctgaaatttcccagtaaattaattgtctctgcatactatgtagattagtttgaaactttaagaaatatgtgtaatgggtcattaaaggtgttatttttattactaaattctattaaaatgtgcatatgtatgaatatatgacatataatgatacaaataataccatatatgtataatgcaatgcttaattataattatgtgtattacatagttatcaaatcctttggttatttatttaatacatcagggaaggaaaaatatattcctatcagctgaaatgtaggagccctttttcaagatattccttaatatggattcttaatcttcaggcaactgccttacaattgtttctgtagctgaatacctcctatattaatctttacttcatatgtttctttaaaacaactcaggaccaaaacaattacccaatctagtctttcactaagtaaaaatactcatgaaataataagttaatgtgcatactatatcaatgcaaactaaaatcaatacagaattaaaaaaaattgtccatgtgctgcctacagttatctcataatttcccgattgtgtgtataatacacatgggaaaacagaattttgtgtgcaaattaattaagagcttggagtttggagtcagctgcctaggtttaacttcttatcctgctgcttagctatgtggcttccaggtcccttagtttcctcattagtaaaatgggaataataaatcatctacctcacagggttcttgtgagaattaagataacattaaaaaactcagagtagtttcacatagttcgtaacacacacactttttgtgctaatttttaccgtgtattaaagaatcattgtgtgggtatttgtattcattgacttttccatgcatgcaatactccaatactaactgttaaattgaaactgaagcccagattatttgctccaaatccaagttctcaatagagttgcagaagcttctaaataagtctaaaaccactttcctgagcagtttatttcctgggagatgctaacttattgttttggacatccattaatcaattcaaactttaattcaaatatttactgagtgtctcctgtgcacaagacagatgatatgaaagggatacaaagatgaatcaatcaggcagagctctccctagcagagttaacaaataacactcgtataattagcaagtggcaagtgccacaggagaggtccacaagagatgagcttcagaagttctgtgaaaagtaaggagatttccagctcagggaatctgggaagatgttaatatttgatcagaaactttaagatgccaggcactctgcaaatcgttatgtgcattatctcatttactcctgaccacatgccaataagttttccctttctgcaaaagcagtaacagaaaagcgaagtttgagctcagggccaacattacaacatgttgttttatttatattatctaaatataaattataaaattttttaaaattacatgtggggggcttggaattactgtttcatttgtattccatcgcacttggtgacttgccatttatgtttttatatttttttaaaattttttattgtatgtgggttcatagtaggtgtgtatatttatggggtgcatgagatgttttgataaggcatgctaagaacatacactaggaaaaagacaacgtgttcaatacacagtattgggaaaactggcttgccatttgaatgctatttactctagtaatttatttctttagaaaattaaatgctacattggtgtcccataagagttggcacagcttccaaaattacttagcctcttccccctgaagcagtttatactttaggagaatgtgtttaatcatgtgtagaataattatatttctgaatatttaaatcataattcaaaataatctaaatcaatattcttagtctgggcttagtaacacactaacattttacattttcctgctcttttaactgtcagccctttgtacatctttacgcattggaagaattcgttgatcagagaggaggcgtctcagcacaggcttcaggttctggtataaagatgacacaattatccagtgtttgccaaatacacacagtttcgaagaaatatgcaacattgttatgtagagcaattcttgaggatggaattgtctccaaattgtcaaaatctgtttcaacataatctcctttttttctttcctattgtaactacgggtgctattgccctcagcagagaatttggtgagctgtggaaaacctgtcaggtgagcaagcttaattagcccagaatagttctttaacatttctaaatccaagccctaaagacagatatgattgaagactataaaaaataaaaatatacttaaaatgctattttgaggctcattaaacttgaattagtcaacatctatttctgcagacagagtcaatttgcatttattcagtggttctctttggacaattaataagtgggtgacattaagtaacttgaatcaaaacaaaataattaaaatatgtagtgaaaaaactacatcaaaaatggaagtgaagataatatgaattcagactctggtcatttgtttcttatgacagaattatatagacaattgtcaatgaccttttttagagaacatcataaataccacataaagtaaacaataacaacaactgtgtctgtgtatgagcagcctcttatttccactttaagaaaccacaagttctactgccaaataaattgagttgatagatgacaagtgatatttttatttttcatctgaaagggctacaaagaaattacctatccttctttgccactaattctaaatatttttttcaaggctctggcaaaaatgtggaggatgtttctcaactttcagacatatctggctaacttaccctttttctacttttgaagcattacataaagggatgtgtgtgaacgaaattttgaaagcctgttgggaaaggaagcaaagtggttcaggcctaagtgttctgattctagttatgtaatactggggccaggaaactttttccataaagggacagagaacaagttttgggatttgagggccacttggtctctgtctcaactactcagatatgcccctgtagtgtgaagtagcacaagacaatacattaaaagtgtggtggctgtgttgcaacaaaactttaacttgtaaacaggtggcaggtcagattttgcccaagagcagtgtttttttcaccactgatgtagtctaatgccaagactgattaagtaaacctagccaaggaagagtattttccattagttattcaagcaaggctgtgttctttacagattgcattcaagtatatggagctgtgactgaagaaatcagggaaatttccagaaggtctgatgggagccatgtcttttggtgactaaaatggatatgtctcctgttattggataatgatgatgaattcctgattgaatatcctgtctgtactgaattctttctgtgccatttagaaaagctaaacttgtttcatttgcccaggtggtgtctattcctggtccctttgccaatctgtgtccatgggtgtttgtgcatcagtgcttgcagcttgatagagactgtcaaaatagcatctgaaaggctctttcaccagagggtgccagaaagttatgatgcttctgaactcttcctggtatgttaaacctgcttcaaagtggcaaaacttggtggacaatatagtgttgaattgcacataaaaagagagcaactgcaatacatcaccaaagtgctctggtacctacaggtatttgggatgcaattccttcccaaggagtgtggtctgagtagcttcatgtggggtcttccagtacaagaatattcaatctccactgccaaactagccaccctcagatctcaggatgaaaacctttcccatcatttctatgttagccatgaatgaggattgcagtgcctttgctggactattggaagttggctctcttcacttttcagggtctattccaaaaaccaagtcacacggtttatggcgtatggcaaatatacatgcagataggaataatctggggtcatgttgagttgagacagtatctaaaatatgccaagaattcaatgccagaaaatggaaactgaagaaattcatagttgagagtaggcaaagcagtaataggatagacagcagcatttgtcaaagcagaagaaatgtcaaatactaactgagaagttgctacgatcagtggccaagtgagtctagtttcttgatcatccataattttgtcatcaaagagaaatttatgcatgggtttccctttcatacaatatcctatttttcctatattactgggcataaagagggagaatttaaaagtttcgggcatttaagagaaaataatggtcctcttatcccattcttctagacatgcagatatcacagacaattcaaatgtcaaaaaatattaagaagacttatgttaggttgtccacttattatttttctcaacaagagcattaacaactctcatatgcttgtattatggttttaagtaaagaatattctgttgccaaaaaaatagaaaagataatataagatttaaaatgttccaatttttaaataaatttatgaaattgaaagaaaaattcttattttacccaagaataatgagaatgcatttgtttattaatcaatgtttgggaaccattaacccaatttaaatacttctcatatttgaatagctttgataaactccctgtaaaatggtttgctggcctatgtctagatttcttcagttatggaaaattctgtaccacttgaagtatgtcatttgttcttagactctgaaatacattcgtactttacaataaaatctgtcttcctataaccacttcattagtccttatctcagttcttcggcatctgtaacaaagggccatagactgggtggcttcaacaacagaatatttgctcaatcagagttctggaagctagaaattcaaagattggggtgccagtgaattcggtttctggtaagaattctcttcctggcttgcagatggcctctttctcactgtgtcctcaaatggttgaaggagatagagatctctagcttctttctcttaagggcaacaaccctattggattagggccccatccttatcacctcactgaacattggtcacttccccatttccaaatacagtcacattggggattagggcttggacatatgaattttgagggacacattcagtccataatcatcctcattttgctttttaataccatgtaaagcaagtatcatctcttttccatataccaatccagtcactatttggaaaattgtaactctctgaagctctactaaccttcctcaaatggtttcaagtttcttcataatatgggcaattctctgaataggggtcaaaagatctttatcactttaaaaagaaaaactaaaacactaaatatgtgaacacatttattgtacacgtttacgttctcttagcaggaacttttattctcattattctaattctaatgtagatactatcccaaaaatggacatgaggaaactaactactagaggaaacagatcttcaatttgtctttcacaaccacttggttgtatatatttagaccattctatgaaaattctaacttcacatatttttccacactctgacctcatgttgtgatatttggaggggcacgctacacccctaaactgaagaagtgaacacaggccatcactggagatgctctacactagctgagaagttactcggccttcttgtgtgccgctatgtcattatcatgacctacctcttgggctagaccttcttggtacactagacttggtgctattcctgacctggaagtaacatatgagagggagaggtagtccttgttatttttctcagctgtgaatacatttttttgtcaggttaaaatttttggaaattcaattatgagatagtagtttcagtttcaggaagcccaatatgaaactttagaggaaaaatttgtttctctcttaatttgtgttattacaaaatatatatgcagcatagtcataaagccacagttctatttctatatgcagttgggcctgctgaatgctaaatagaacaccaatattcctgttactcataaaatgtactagctaggttagtgaatgccagagaaagtaaccatttcttaaagaaagacagattttaagggacttaacttttcagtgcaatatgttagcatgctcctattccttgtgggctctcagatgtacaacaaacaagcaaacaaaaaagaagcttagctgatccagcccttttgcagcaaagggacccagaagtgtttttccttgaaaacctgaggaaaatcaatctcagggagaaacaaacatgctgtaggtttgttttatttttaacataatagtgcacccaaaaagtgacccttcctggaaaattttgctccaaagaatatggaactatatattttgattatcacatcactgtgctaagaagtataagaatacatttttagataaaacttttctttatgatttaatcagaaaatatggtttttttttgtgcctactatgtgcaaggccctgtccaaaatcctatggatagaaatgaaaataaaatttcatgagtgtttccagcaaactgctgtccggaaaattcatggacaagtaaactgactgcagagcgatatgataactactaaaggaatgtgtaaacaatgttataggaatacgaataaggaaaagatggattgtgactgaggggccagggaagcattcacaatgcagcttaatttgaagaagataatatagtccatatgatacaaaatatcactttaaaatagtattaacattttttagtctacaatcaggctcatttttgatcattttaattaaatattctagttgtattgttgctgtaataaaagcaactatctttcaaaacaaattttcacaaacctaacacaaataagaagatcttcttttgggcttgaggaaaatatgatcacaaaagtattcctttaacaattgcattttttttcttcaaagttgcttataatttaggacacaacacatacacacttacatacacatataattgcactcatcattgtttcaatgtgagagttagatattttcattttccctccactctcttgattaaggcaattattactttaaatgtaagttggatgtgtacatggaaatgacatttagaaataggccatgctattattatgtcatttaagcatttcctcagaagcatctttgctttcttgcaattggagtaagttgaattttatattgcctgatagctttagattgtttagtcaaatttttccagaaaaatttttaattttgtttatatgggattgtttgaacattaagtttagagagatgatatcaaatagcctggaagaaaccttcaagaatatttttgtaggagctggtgctgccatttatctcctcataattttatagaaaagcttcagcttcaacatcttcaacatcaactacttgccttcagataataagtagaaatgacaacagtaagacatagaaaaataatttgcataagcaacaaaatctatacagaaaataactaaacgtaagtataggaacacatttctagatcatatactctaattttaatagaaattcataaaataatgtttaaaacactagagtatactttccacaggcataatagttatttaagttacaaaaaagaaagggtctaaataatttttcctaatgatgttgaagacttctttctttccaaaagtagaggttgctaataaagaagctaagaataaccggtattctgacaagaccacttgaaaacaatctatccacaaatgtcacaaaaatttcatagtaaatatgcagaagtattttcttgtgatattatctcaagatacaaggttctgattttatagtttatattcaacaaattacagaaaatataattattctttaattattagaatagaccaagaatgaatgaggaatgtatcattcctgaggtttttcttttctttatttttggcagtgtcagtgtgagaggacataaccctctactaaaactataaaataatatgaagtaatgtatttactttgatttttacttcaacagtagtgtcacaagttaggttattattataaagccactctaagacttcatcagttttatccagagcttcatttaatctgttaaaatttacatcattctcttttaaagtgcctatcatgtgaatatccttgtcaattttctttctttctctttcctttctttttccttctttccttctttttctgtttcattttctttcattttctctttcttttttttttgtgcagtgtgtgatcatggctcactactgcagccttggtctcccaggctcaagcaatcctcccaccttaacctccagaagagctgggaccacaggtgtatgtgggctagactttcttttcttcaattcttaactgatataatcctgcaatattctcatttatttgtgattctgcatataatcaagtggttttcaatgtcgatttaatcaacactgagaaagcctttatcttttgtaagatatacatttttttattttataaacaattgcataggatttgccctgtgtttcaacattggacagttggcaaaaaaataaagtggacttagactttggcattgatgtgatcggttaaattgcacactgatgttaagctgagaggcatgcttgagtggcagggacttggtggtgacttcattaatgaatgttttcatgtcttgatcacgtttttcccctgtgcaacctattaactgtgacttagacatattatttaatatttctgacattagtttaatttctttgtttttaaatggaaatagtaacagattctgccgcttagagctgtgataagttaagttacttgtttttttgtaatgtgcttaacaggccttctggctctgaacatgtcgtcaatacacgtttactattatttcattaaaagctatgcaaaatcatcgtcaatctaccaaatagtgtgtcagaagtgcaacacaatttatgcaagatgtcttgaactaactataacttattaaacaatctttctcatttcttacatttaactttatcacagcaaaaataaatgcgaacaacatcaaaatcatattaaaatgtacagtatatctactgaagatttataaagaccaaagggaggcagaataagtgtagtcatacaacaagattttctaagatgtatatttatacattctttcctctccataaaccccacatttttaatagctggcccagagcttcgttcatctctctaccctgtcttatcttcagccttttatgacacacatcatgcagcccttatctatcatcttcaacatttcagtttttttccctgtacagttgattatttcttatccatagaaatttagtctctaggctttttcctgtttcctttaccaaatttctggccaagaaaaatctagggaccacgtaattccataaaaaattctccataaagaccaagaaacagacttattagtatcttggccatggctgactttggttcttctgtttctgttcttagtagctgtgtaaacttagttcagtcattttactcttagttttctataatatagaatcagggatttaaactctatgatctctaagctgactttcaactaaaattttgtatgtgtttctaattatttaaaccccaaattcaagaacattatgaatatagcatacatgcaaaataacaataaacatttgcttatttttgtgaaaaagtttcttgcttaaacgtaggagaataaaaaatgtggtactcaaaacagataaaaatttatttccctttctcttccctgctaatggtgaataaatctcaggctgcagtaacatgttttaaaggcttttctacctttaaaatgtatctaattattagaaaaatcaatctaattaacccaaattaagtggatcttggaatttatattgaagaatgtttacccacttttacattttaaagaaaactgtacaattagagtggaataatagacattggaaactttaaaaggtgggtgggtgggagtggggtgagggatgaaatacttcctattgtgtacaatgtacactatttgggtgataggtacactaaatgctcagacttcattactgcacaatatattcatgtaacacaacagcactggtacccctaaatctataaaaataaaaataacctgtataattagtaaaagatgactatttttaatggaatttttattgttcttataagtttttgttttttttactcttcgagtatcattcaatttacttgtgttcagacataaattcaaccattcagaagaatatcaaggaaaagtaaacatgatggtgaagttaggaagtgattaaaatgatcaaagaaagaaataaaaaataatgacacacaaaagattcttttcaactggaaatagttacaataacctaaggaacatgggcaatggcaatagaagaatgagctactggctagcaaatgagagaaaaaagcaggaatacagaagaaatagagaaaaaggagggaagtgagtgctaggctacatatagagcagaaataatcagaattggcaacacatgggtgacatacatctctatagtttgaagctgtgtcagcagagactcaagagagctcttagagaggagagaggggaactatcaactagaacatcaccatagggcaagctatgtctcagcccctccatcactcttaggtgtgcctctgaagctctggaaaatcaggccacttttatgggagtaagacaacgtataagagcagccatggacactcacaggaaagttacaaccagcagtctttgacatctctgcactgagagtgtgccactccaaataaagggcaattcatttgtacagtagtccccccttattcatgggtgatatggtgaactgagaataatattgaaccttaaacagtatataactttttgcatacatatatacctatgataaagtttaatttataaattagacacaataaaatattaataacaatagtcaagtataaactagaacaattataacaatatactatattaagaattacatgaatgtcatctctctctcttcctctcagaatactgtaatatatttggactgtggttgtacacaggtaactgaagccatggaatttgaaactgcagaaaaggaaggactactgtaatctgcagaagcactaactagaacagagttcagagaattatattgtttgtaatttgaaaatatgttagtataaatagcatgatggatgtatgtgcctgaattacttttcatctataccttaggaatatttggttaatattttaaggttttgtagatcacataactaagtctgcaaccttatctttatcctacattaattttttcaggttgaatttgctcttctgccattaggaagtgaagtgaagttttctttcccgttaatattggttgactcagtgacagcattatgaaagtaacagaggtaacattttaggactccccaaatagtgatatttcaggagcttagaaattaagaaggcctggcagtgtctgcttttgtgctccaaaaagggagctaccatgtaagaagtccaagaaagttgagatggtcatgttttacaataaaaatgtcaagctagccatatggactggcaataggtgagaaagagagagagatagagatcctcactagaccaaccaaatggctgaactgtaagcaaataaattttatctattgctttaacccactaacatttaaaaaatttgtcattttatgccatttgcaaacaatttattttctgtacataaaataaattgatatctaagagtgggatgatgtttgaacaaaagggtaaagcatattgccttattttggggaccaggtattgggtagagattttaagattctcaaggaggctgttagcaaaggttgcaagaacaggatgaggttgctattgaaggccagagaacagggatcctgagtgatctactggcagaaaaaaaattagcaaaattaatacctgtggcaatgtggacaataggaagaaaacttaatgatcttgtgatctgagtaggaagatttctaggctgttgaaagtgcttgctctttttagttgcatttcttttcgttgatcatgacaaagttcttttagttgattatgacaaagtttagaaggaatgagatgtggaaagaatgttcagcgtttaagaagaatttagtgcaatataaaggagcttggacatgtcagatttgaaaataaactgtttctcatcctcattcttgcttaaaaatagaaaagattatcaaagtaaaaaatagttacagaacaatggtcgaatcccaagtgatttcaccaaatttagcctcataataaataccaaaacaaaggtttaacttttttgaaacctcagaaagatttaaggtggcatttcctaaagagtctctgctgaggaaatgggcatatgaatatattaagtatgctttatagatcctctcttcctagcaaaaatggctcatgagaatctcatggacactgatccaagcccaaaatagaaagaaatgtgtcttaaggagattcataagtgtggcttttttctaagggtatgaaccacttatctaatagcaaggaaacccacaactaaaaaaattatatatatttgtaatacaatggacagagatgggtcaaaatatagagacttctgctctcctattcttcaacttattaaagaaagctattcagttacaacttaattcagtgtttttggaaagagagggaggatggaacacagataccagagagtgtgtctaagagccactcccagggcatatagcaaagtttctaaaataggaagtggtgataaacacctagttggatttcagaaaaaaaaaaaattatggctgttatctttgatctttttacattgtgaatggggtctacggggatgagataatgtattctatattgcatatgtcattgaattcagagcggctgcattgaagagctgtacttatgcaacggcagcgtggggagctaccctgaggctcccttcccacagctcttccacaatgtgaccatagcattacttctttaaggttagatcttgtgccactcatcttgaatctgggtttgtcctgtgcaaactttgaccaactgaatgcagcattctggaatatttgagcctagacacaaggagcctgacatcttctacttttgtttaacttttattttaggttcaggcatacatatacatgtttgttatataggtaaattgtgtgtggtgggggtttggtgtacagattatttcatcatccaggtaataagcgtagtatccaataggtagtttttcgatcctcaacctcttgccaccctccgccttcaagtaggtcctggtgtctgttgttctcgtctgcgtccacaggtgctcaaagtttagttctcacttgtaagtgaaaacatgtggtgtttggctttctgttcctgtgttagtttgttcacaataatggcctcctgctccatccatgttgcttcaaaggacatgatagcattcttatttatgacttctttcgtggtgtatatgtaccacatatttttaatccagtctaccattgacaggcacttactttgattccatgtctttgccttgctctttgtgaatagtgctgcgataaacatatgtgcacgtgtctttaggttagaatgatttatattcttctaggaatccaataatgggattgcttgttgaatggtaatttttttaagttcgttgagaaattgccaactaatttgcattgtcaccagcagtatataagtattctcttttctctgtagccttgccagcatgttatttttttactttttaataatagccattctgatggtgtgagactgcatctcattgtggttttgatttgcatttctctaatgattagtgattttgagcatttttcatatgtttgttgcccacatgtgtgtcttcttttgaaaactgtttgttcatgtcctttgcccatttttaaatggggttgtttttgcttgtaaatttcttcaaatttcttatagattctggatactagacctttgctgtatgcatagttttcaaatattttccctcattctgtagtttgttggtttactttgttgatatttcctttgctgtgcaggagctctttagcttaattaggtcccatttgtcagcttttgtttttgatgcaattgctcttagtgtctgcctcatgtaatccttaccaggtcctatgttgagaatggtatttcctaggttatcttccagggattttatagtttgagggttacacttaagtcttttaaccaccttgagttaatttttgtatatggtataaggaaagggtctagttccaatcttctgcatatggctattccagaaccatttgtcaaatagttattccagcaccagtttatcaaatagggagtcctttccctattacttgtttatgtcagttttgtcaatcagatagttataggtgtacagcattatttctgggctctcgattttgttccattgttctatgtgtctatttttataccactgccatcttgttttggttattgtagccttgtagtatagtctggtaatgtgatcacttcagctttggtctttggcttagcattgccttggctattcaggctcttttttggttccacatgaattttaaaagttttttctaattctttgaagaatgtcactggtagttgaatgggaatagcatttaatctgtgaattactttaggcagtatgaccactttcacaatattggttcttcccgtctatgagcatggaatgtgttttcatttgtttctgtcatccttggtttctttgagcaatgatttgtaattctcatttagaagtctttcacctctacagtgaaaattacagaacattgatcaaaacagacaccaataaaatagccacgatatccctgtttgcagacaataggattctataccaagaaaatcccatagtctttgtcctaaagctctattgtagagctgtattcctaggtattttattctttttgtggctattgtgaatgggattgcattcttgatttggatttcaccttggatattgttgttgtataggactgctactgatttttgtacattgattttatatcctaaaactttgccaaagttgtttataaggtcatggagctttagggcagagactatggagttttcttggtatagaatcatattgtctgcaaacagggatagtttgacttcctttcttcctatttggatgtgttttatttctttctcttgcataattgctttggctaggaattccagtactactgaataggagtggtgagagagggcatccttgtcttgtgccagttttcaaggggattatttccagctttagcccattcagtatgatactatgtatttgtcatagatggctcttattattttgaagtattgtccttcaaatgcctagtttgttgagggtttttaacatgaagggatgtggattttattgaaagccttttcattatctattgtgatgtccatgtggttatttttaattctgtttatgtggtgaatcacatttattgatttgtgtatgctaaaccaaccttgcattccagagacagagcctacttgatcatggtggattagctttttgatgtgctgctgaatttggtttgctagtgttttgtttagaatttttgcatctatgttcttcaaggatattggccaaagttttatttttatgttgtgtctcttccaggttttggcatcaagatgattttggcctcacagaatgagttagggagaaatcccccctcctcattttttcagaatagtttcagtattaatagtaccagctcttccttatacatctggtagaatttggctgtaaattcatctggtcctgggttatttctagtttgtagggtttttattaatgattcaattttggaacttgttattggtctgttcagggattcaatctcttctcggttcaatcttgtgtggttgtatgtttccaggaatttttccatttctactatgttgtctagctcgcatgcatagaagtgttcataatagtctctgacagttttttgtatttctgtgggttcagtggcaatgtcccctttgtcatttctgattgcgtttatttggatcttctgtttttcttcattagtctagctagcagtctatctatcatattaattctttcaaagagcaagctcctaaattcattgatcctttatggttttttgaatcttactttccttcaatttagctatgatttgggttatttcttgtcttctgctagccttggggttggtttgctcttgtttttctagttcctctaattgtgatgttaggttgtttatttgagatcttcctaactttttgatgtaagtgtttagtgctataagtttcccttggaacactgctttggctatatcccagagattctggaatgttgtattgtttttccattagtttcaaagaatttcttaatttctgacttatttttttgtttacccagaagtcattcaggagcaggttgtttgatttctatgtaattttatggttggttttttttttttgcattggtttctatttttattgtgccatattctgagagcatggttggaacaattttgggtttttagaaattaattgagaattgttttatgcctgattgtgtgggtaattttagcgtatgtggcatgtgtggatcagaagaaggcatattctgttggtattgggaggagagttctatagtatgtttattaggtctatttggtcaagttgaattgagatcccaaatatctttgttaattttctgccttgatgatctgtctaatactgtcaatggggtgttcaagtcttccactattattctgtggtcatctaagtctctttttaggtctctaagagcttgatctatgaatctgaatgctcctgtgttgggtacatatttttttaggacagttaggtcttctagttgaattagacctttaccattatgtaaatgcacttctttgtcttttttttaaatccttgttggtttaaaatctgtgttgtctaaaattaaaagagcaccccttgcctttttgttttccatttgcatggtaggtttttctccatcccttttatttcagcctatgggtgtcactgcgtgtgagattggtctcctgaagacagaataacattgggttttgcttctttatctaatcttccactctgtgccttttaattgaagcatttagactgttcactttcaagtgaacatgtattgacatgtgcagatttgatcttgtcatcatgttgttagctggttattatgcagacttgtttgtgtggctgctttatagcatcactggtctgtatacttgtgttttttttttttttttttttttttttttttgtagtggccaggaatggtcttttcctttccatatttagccctcccttcaggactttttgtaaggtaggtctggtggtaaaaaattctctcagcatttgattggctgaaaagggtcttatttctcctttgcttacgaagcttactttggctgaatatgaaatccttggatgaaaattattttctttaagaatgctgaatatatgcccccaatctcttctgatttgtagggtttctgctgacaagtctgctgttagcctgacagggtatcctctgtgggtaacctgcccctactttctagctgcctttaacattttttctttcatctccacattggagaatctgatgtctctgtgtcttgggggtggtcttcttggggatggtgtagtattttgcagggtttctctgcattttgatttgaatgttgacctctctagtaaggttggggaaattttcatggatgatatcctgaaatgtgatttccaagttgcttagcttttaaccctcttttgcagggacacaaatgagttacagatttggtctctttacataatcccatatttgtcagagattttgttcattctttattgtttttcctttatttttgtctgactaatttattttggagagccagtatttaaactctgagattgtttcctcagtttggtcaattctgctgttaaagtttggtcaattctgctgttaatacttgtgattgcattatgaaatttttctagtgtgtttttcttctccataaaatcagttggctctttcttataatggccattttgtctaccagctcctatactgttttattgtaatccttagatttggttgggttttgactctctcctgtatgttgataatctttattcctatccatattcttaattatgtttctgacatttcagccattttagcttggttgagaaccattgctagggagctattgtggttgtttggaggtaagaagacactctggctttttgagtttccagagttattgtgctgttttttccttatttgtggggattatgttctttcaatctttgaagttgctgtcctttggatggattttattgttgttgttgttttcttctttgaggggttgattatggtataggtgtgcttggttgaatggcttcacttctagtccactcctgggtcttggaggagccctctctgattactgtctccatgcccacatttcttttgttctggcccacaaggatccttcaggcaggggctgctgttggcagacaagctgtattgtcaggttggccctaaactgctgtctgtgtgcttcatgtgaaacagaggattgtgcctgcatgcagagtttaggtggaattgggaccactgggttggaagctctagtgggtgtagcctgtctagcaaggagaggttggtgtgggtggagttgcctgccctgccatccgggtgtttccaaggcaacaggaagctgtgccccttggcaaattcaggaagaagtaggacggctgagccagaagctctagcaggtatggctcacctggctatcagcaggaggggtgggtagagcatctgggttcctccagggacaaaagaagtctatgcctgccagctaagttcccatagaagcaggaccgttggaccagaagctctagtaggcttttcccacctggctatcggtggaggtgggtgggtcatgcaccctgctttccatgtttcctgggacaatagaagccgtgctctccagctgagttttacagaagcaggaccacagggtcagaagagctaataggcattagctgcctggctatcagcagctggggtgtgtggggatgcctgcccttccaggtgcttctagctgcactctccagttgagttcacacagaagcaggaccacttggctggaaactctagcaagcattgcctacgtggctactagtggcggggcaggtaaagtggctggcccagttcagggtgaagggagaccactgggctgaaagctggtgccaaattccctttggtagggttggcggggggtatgggagggtggaggtgtggggggtgggggatgagtggtgtgggggttagggcctgggggttggagcaatctaatacgaggcaccacaactatggcctctattgggtctatggcaccagtgctggcaggctttgtggcccaaggcttgtagaagtccttttgaacttgagaattacctctgcataacatccaagtggttctctgcttcagtgtagaaggctggtgggtgtggggtgggtgcaggggagctgggggattttctctatcccagtcttgcacagatccctgtggagagcatgaatgcccctgggcactctcacttattcaccctttcccatgttggagatgttttcctagctccatgctgaggccagataggcgggtgcccagctttgctcttctctgcttcttgtgttccccttctgctttaattgatcccaactagtttctcagatgatcagccttacagggccactgctcactggcccttttgtttcctctacgtgagagtggcatacaagagctgctgctcgtctcccatcttagcttatgcttttatgtttgggagaaatctagtaccctgaagctgccaaacggtaaagtagtcccagctaagcatacagaaaggtactatggagagaatgagagagacagagacagggagagggagagagccggcagtctagtcagtcttctttttcaactgtctttgctgagacacgtaaatgaaaaggtcattttggacatttcattcctaaaagattccaagtggagcaaaaaagagttctcttcactgactcttagcaaaattgcagaactgtgaggaaataagttatatctgttatttttaagtactaaggttttggagttagttcattacaaagcaataaataaatatcttagtcagaaagtaacacttaaaaattggttacttaatacttcagatgtccttatgaaaatacaaaatatattttgttaattagtatatgaataagtattttccaatcctgtggtcatttagaaagattttccaattaagtataagaatatgtatggcaagcaaagaatgacttttggtatgcagcctcatttgtcattttcttcatccactttacagaagctgtcacttgactatatcgcaatgctgatttgctattgctgccatcagaatgtcatatgttagcctcaaaattaactcttcattgaaaacatgagttaaagagcttaaggacagtgtgaaatttttccagactaaatgaaagggtggtaataactatttatgcctctcggctaatatatgtttgcatgttggacagagtttaacctaggcttgctttctttgtaatataccacatgcaggtgagggtgtggggtaggagatatggcagatactatctacctaccagagtcttcaggtgcttacaaaaaacctgaagacagctgaagagccaaattgactcaagacagtttgcaaaaagagggaattctggccaatggtagtaagaatgaggagtaaagaagaggtttgattattatagattattttctccactttgtattaataggttttttagagaaggacaaaggaaaggagacagacaaaagcaaagatatatatgaaagtttaaaaaatgatacattctgtataaggctctataatacacaatctcaaacaacagaaatgataccaaatcaatgcaagagtatccttttgtcaacaattgtgttttctttcatttttaccagtgagcctaatgcagactaaattttattccattgaaattaatacaaaccaaaaataaaattatattcaatatcctgctattccataaaaaaattgtgagtccttctagaggcagataaaaccatggagattacaaagcaaaataagaaagatctatcatttcaaagagtatgtaccatagtggaagaggacagaagacaaagtgctgattgcagtaaaaataagataatatttgctagaatagacacaaatctacaggtttctgtggaatcctgtttaggggaagttaactcagacttaattgtcagggaaaccttccttgaggaattggaggacaggacaacaggagcttcctgggggcaattagagatggtcttctaggtagagacaagaactcacactaaagatacagacaaaatggggtctggggacaactacatggaattacaaccctgaggataaatacccaggcaaatgaaggactggggaaaaatcagtgttagcaaactggaataaaaggaggctgaagaatctgaaataagtcggtgacataatatcttagaaacttccctgctccacgcatactgagaattccaacaatttctacaaggtatgtgaggggcctgagctattttgttttctgagaggtggctttagaattctgcactctctctaggataatcgcattccttttcattgcttccactacagctaacctatcagacatcgcctctgggatgaagtcattgtctcagggaaatctcaacctgattttcccacaggcactttagactaattggtacaaaagtagattcgtcatttgaggcttacaacaagcctccaatatacataataaaatttattttttttaaagtgaatttatcatcttttctcattgacttgcttcctttcctatattttctatctcaggataggtttcctcagctacataatcagcccagaacagaaacctggctgatatccttgactacacccactacctcaccttaaaacactgaccctgagaaggcagagaaaggctttgtgaatattttcattaatgcataagatccaggaagatggagattattcaccagtgaatccccaacacagaataatgcctggcacatagtggatactctctagctggatgaatagatagatagatagatagatggatagatagatagatagatacatttgttggattaataaatgaatgaatttctcatttatttttgtcagctcttatctcattgaaaaaaagcatactaatgaattaagatctttttcagaatatgaactgattcaaaaggagcgtccatagatagtgaatccaaagaaacatattaggatttttaaatttgttataatactaaatgcttttaaaactttgtttaaaacagacattgcattaaaagtcactcaaagtagacccaaaacaatggtttgggtaaaaggtgtttgactttgttatttgtagtgaggcagtatagcgtaggttttaaaagtgtgggtttgaattttggcccttgtattcaatgactgtgtaactaaagtcaggccattcagcctctctgtgcctcaattcccttatctgtgaaatggagatactaatattacttactgcaaagagttacttaaaacattgagatagtaaatgtgaagcaattataagagtatttaccaaagggaatgtgcttaataactattaactactattagaaggacaataattttataaaggcattttgtaaagttgtgtttttgatttttttttaatgaacaaatgagcttccaaaatgatcttacatggctgaaacatcagacccgatctctccattgtggtctaataagcaaagcaagcgagatttacaataaagtagatgttggagctatgctgactgggttcaaatcctcataccatcactgcctagttgtataagcttgaacaaattacttgttattgctgtgcttcaatttcctcagctgtaaaatatgggtaagtacgcatctactgggttgttgtaaggattaaatgagctaatatttgtaatgaacttacagctgaccctagccaaacaaacaaacaaacaaaaaaagctacatgctccagaatgcttgcttacttgttgaatgagtgcatgaatgtcctttaatgttgtatacatgatgtgtttcctccctttaataataaagattaatggatatagtgtcaaagcctgaggaatggttaacagacaacatcagtgacagtgaagaacaagatttcatggaagtatgaaaataatttttgttttcttattctagaagggtagacaagttacactgtcttaaataccagcaggctgaatattcattaatctgtttttctaagtaatataaaaataaaacatggtgagtattttagaaaaccaaaatgataattatttttaaactaaatatttaaaaaattattaatattagcatatgaactaggatcaaatgcttcataacatgagcttctatttatgcatcacagtcaatttctaaactttcatttccagaatggagtatataggactagaaataacttcaaaattattgttttatgtttgattagcacagagtagaatgaaatatcaatgctggggggaaacttaaaataatagtaaaggataacagttattaagtgttaaatgtgcaatatcttaatcattcttccttaaaccttaagaaggtagagtctctattttgcaggtaaagaaaaagcccaagcaagcataaatggcttgtccaaggcaccatggcaatgaattgagggagctaggaatccaactccagacctacaattcttaatcccacatctctactggcccttttgagttagcacttgtagtgatattactggcttcataagaaagcactattgcatgtcatggagaaaatggagcatatctcaaaaaccttaagttgacaaagtcttagcactaagaggattggtttttaattatcagaaagctagttttgtcatatcatgccctgtaactagatactgttcagtttctgtcttcgaaggagcagtgtagttactgataaagcaatgtaatattttacaattgactttacaaagtactttatttttatctttatggattatgctgaaaattctctaaattcatgcttcacatatttttttcagttctcaccctccttaaattttacattatgattttcttatgtaagatcattcacctggggtttctgttctatagcctttagctaaattagccttaagtccttaaatttcactagaaaactatctcccaaattaatagccccaaagcacttaagccaaaaattgattttattttacttgctgttgagttacatagaccacactgcaaaattaaacagggtttttaaattgtgatctatattactagaattccctaactaatataaaccagattacttcttgttttactttacccatttttccctaaccacttgcaagggaatattgatggactttgatttgataaatctattaacatagaaaaaagtgaatatatattcatttgtctctattttcttctgtaaatttatttcgtagtttaaactatagacctgagatgtgttattatatggttttgttgatttgtttttgttagttttaaaatgaaaagcctttgagatcttttagaattaagtgaaaatttaagcagaacagaaggaacaccagatgggagtctctcaagaagtgtcctcagggatatcacatgaaagtgaggtgatcttaggtgagcggaacacaatagaatttgtgactgagataatatcttaatacaaagaatgtctgtgcaatttatatgctgaggaaatggtatgtgacatatatatgtacatatgcctacatatatatgcatagaatcatcgtgaactggaataaacttaaaaaaataacgtagtccaacttcatcatttatggaagagtagcttaggggaaagagatttcaagtaatggttaacaatgtcacaaaactcattattttttggcagaggcatgactaaaaatcaggtgtccttgtttcaagcctggtattttttctatcaactcaaattgtgtctgggaaaagaatataaatttattaaaatatagattttcccccatgtagcaatatttgctgatttgcaacttcaattttttttttattccaggcagagttacagagcattacattatagacatcattctctctgagggtaaagattttggcttgagtaccaaaaggctatgaagcatgcttaataactatatgcttgaaacaacaacttgtacaaacaaatgtaaatgtgttaatttgtgtttgggatttcaataatcacctcatgtataatagctgtaggaaactacttggccctctatctggtttcttttcatttatagcttcatcacttttcaaactcagtactgatgttgctcaaagctgagtgatgtacggacatttttcacagaaaaataagtttcagaaatcttcagtattcccttactactaattttagtaaaatattactattttatacactttatgtgaaatataaacttagatacaatttcctcatatttattgcctcacaaaattataaaaccaaaacaatttgacaagctaaatagaaacaagtccacaaagtcataaaattgaagttagactatttaacttaatgtaattattggtatgaatctggtaaaattaaattgctatacaccaaataattttagcactgattgttataatacaggcactttaaaaaataaagattatggccgagcagggtggctcacgcctataataccagcactttgggagtccaaggcaggtggatcgtgaagtcaggagttcgagaccagccttgcaaatatggcgaaacccgtctctactaaaaatacaaaaagcagccaggagtggtggtgggtacctgtaatcccagccactcaggaggctgaggcaggagaattgcttgaacccgggaggcggaggttgcagtgagccgagaaatcgtgccactgcactccagcctgggtgacagagcaagactccatctcagaaaaaaaaaaaaaaaaagattacaacacagatattacatgtataatacccacaggtgtatatgcatacaaatatataatggatatgaggatataagtattttaaagactagtgataaaatgaacacgcatgttctttttactaactttctttatactaacgttctttatactaacggttctttatactaactctacctagttagtataaggcattatgagcaatggtgatacctgctttgagccttaaaaactactctttgatctcttctccgttcttacgtggttatccctgtactgatttctaagttttctagtcctttatttctttatcatctaccaaacatatatatgcacacacacacatacacacaaaaatatatcagagattacatattgtttaagttctcctatttgggaaatttatataatggggatatttgtttatgactttctttttttctcttccatgttatttttttgagatgtattcatgttgatgtgtacaggtgagaatcactgattttcactactgcatatgttttttggtatatacagtatacatactactgtaagtggacgttattgttgtttttactttttatattataaagacttttgttatgaacattccagtaccatgtctccttatatatacatcaaagaatttcacctaaacaggaaaattttggtgtattggatatgtacatcttcaactttttaagtgatgccagatggttttttaatgcagatttagaaaaactatatatgtattaaacttttccctgcagttgcaatttacatacttatcagttaagtaagcaaattcatctaaaatatcccctttttgtcagggcaaaacattagttcttaaaagaatacagatggtgttcctttactcatcatcatgggctttaatagaggtggtcatttcttttataagtgtattaataatatccatatcaaagaatccagtggatgtctttcagcccttattctattttgttttttcatttttggtttcagttttagcccttattcttgctagacttcactgcagcaatattgaacagcccctccttctcaaaactttgttcttctggctttaatgataatacattttcttggctgtgcccttgcccctctgcctgtttttctgcctgatattgaattactttcttattaaatgtcagatttcctcaggactttgttctggaccttcctatctcattctcttcactctctcctgaggttatgtcatctggcctcacgtatttaaatactatagcctgagaacttcctgaatcatgaatgtaagtgttaacttggtaaccttccctacaagcctcagaaacacctcaaacttaaaagtgtccaaactaattatcttgttattctcccctaaatattttcttctcaatcttccccatcttaatgatgaccctcacctccatttagttgcttaatccagaagtctgaggctgatgtttgactctccctctcacatcttcataggtttacatgtgcaagtgtacagtttatttctgcattttctaattagattaaataattaggatgatataaatacagtggtacatctaaaccagagagtgcttgaatagaagaaactatgattaaatgaatggagaccgtttcaaactagaagcacacacaaatggagagatcaaacagaggtccgaaggatgttgaaaacacacagattaagagagaatcttgagtggagacagatccagggacaggcccttccggactattggcactcaagagttttataagggcaggaatacatagatgcagagctgaaaaaaagatgcatcagagtaaaaaatgggaagagtggtgggtgggaaaaagtggagtggtgggaaaagaggtttccttctgttgggtaggagccagtttctgctgctccagggagtggagtccaatccatggtgtattgttgtctcactaagaaaggcaaggcctgcctgggcacggtggctcatgcttgtaatcctagctatttgggaggctaaggtggatggatcacttgagctcaggagtttgagacaagcctgggaaacatagagaaaccccatatctacaaaaaataaaaattaaattaaatttaaatagcagggtatggtggtacatgcctgtagtcccagctactaggggggctgaggtgggaagattgtttgagctcaggaggtcgaggctgcagtgagccaagattgcaccagtgcacttcagcctgggtgacaaaagtgagaacctgtctcaaaacaaacaaacaaacaaaaaataaggtgggtcctcatgtaggaataaattgtaaattgagagtgattcttatacgtgcaaggaatgggaaataattcttattggatgagtctgcatctgataatgtcttgacttgtgattcagtgccctcagcagaatagacaccagatgcccaagtccaaatggtagtccagcggaataagcagatgggtgaatgaatgaatcatttaccacataacttctagaaggagcaatgggtcataaaacatggtagtgaaaccttgatgtctctattactttgcttatgtttatcagaggtttgggtttattttcaccagtaagtggacccctataaatggctatttaagagacttacatttgttgtgcagtgattctctttttacacattgttggacagaaaatgaggacagggtaatgattaacttttatccctgtaatttacaaaacccaaaagtgttgaatgttgttacctttcttgatttcttcaatggtgtgttttaattttttctaattattttgtgtccattagacaagtgtctttgaagagctgaaaaaggttgacacgcatccttttacagaatatcataaacacatttagtgaggtgccactagatacatataatgtctctaacttgataagctgggacaagtaatataagcaacccaaattttctacagataactgaagtggtttctttcttcatttgtttttcaggaatctctcacaagtccttaaagagaatcctgtttttatgttttagacatttcatagtaatttattttggctaaaggattttgatggctaatgattgacagggctttttataaaagtgaatggagcaaactaattattgactttgtaagtcaatgtcttgaacatacctgaagtgcataacactcatttgctttaccagtgtccctatttccaaatggattcactagaaattaaaaaaaattaaattgttaaacttctttactgtgttgaaattataaactaatttgaaaattaagataatgtttacatttttggagtcggtcactaattcttcaaaaattccagtcaaatataatagtacatgcaatcacacatgtgttttcaatcctagtgacttacttacatctgaaaaaaaggtagcatctttctagaacttataatatcaacttctgcatatataaaaaacaaatctaattgattaacaatatttatttatttccataattattttatttcctctcatacttagcaaagagaatagctggtaacatctgcatttactaggaattaagatttggtgtccttaactaacttggacccgaaagcaagagtccatgcactgaaaagtgtaagcaattaaagcactaccaaggaaagtgtttttctaccaccagagagaaggcatttactctcagaccttgaaagttatcatcatttatggtcatcaggggaagcagagtttttcacaccccaggcacaaaattgaaagtgtctgtttcattctcttctcacatcctgagctctgggtgattttgttaaaggaagcattaaacaacctgtcagcacatacacattggattagggactcttatcatgtggaggggctctggccagttcagaaagacattattggaaacttaggggtgagagcataaatgtaacttaacactttttggctcgaggaatcaactatagttcttttccttagtgttttatattacaaacctgttgtttttaattttctgagcactaacagcctactgtgcttaaacagcttttaatcagaacacaatgattagatagagcctgcatgatacttagatattcagaggagctgcattgcccagaaacatattcagaaggctgaatttcctatctttctttttctgattcatcatacgagttctctttaagaattatcatctagatacattttacagtttgtatcagtcatctggtatatagcaatataagtgtatgtctcagatacatattctagcacacacacatacacacatagttactgtgacactgtaacagtataaaaaagaataaaaaatcaatgaggggctgacataaaatctttcaactacagcatatttaacaaggagggaaaacctgcttagctggctgcctttttaatttcaaggtaactttattggtccaaatactgaatgttcctccaaatttgattataacaaatgtccagttcccttacatcacaggatgaatgtcgagttttttagtgagataatcctttagtaaaggccaatgtttcagacaaggttttaggagaaaaagtctttcgaaatttagtcaattattatcatcatctttctgcaatttcaaaactctgtcctcccctacataacaacctctctgacttattaacaagcttctagaaaaataacctaaaaccactctgttgcttcttccagttcatttattcttcctcagaatattacaatttgatttttgttaacattttttctccagaaactggtgggtgaacttttgtaacattggtgttcaacagatgcttctttttccatctttggttcttgtgacatttttttcctttgtctacggccagcctctctattccttaactaatttggcatgtacctctttcttagcctagttcttgattgctgattcccaattctcagccttcttttattttaatcctcaaaatcaattcaatcagttattatggcttccaccatctcctgtgcagactcccacagccatatgttaatgatcttttgtgaaccgaaggcccgtatttcaaatgacttgtgcctcacaacattccactaataggaatgatattcagcaggaacacacacaaaggactgatggattagtggtgatggcaagccagttgttaaatatttgaaaatcatttctgcccaaaagcaactgtattagtctgttctcacattgctaataaagacatacttgagacagggtaattgataaaggaaagaggtttaattgactcacagttccacacagctggtgaggcctcacaatcacagtggaaggcaaatgtggagcaaagtcacgtcttatatggcatcaggcaagagagcttgtgcaggggagcccccatttacaaaaccatcacatctcctgagacttattcactaccaggagaacagtatggggaacagaactaccctcatgattcaattatctccacctggccccacccttgacacatggagattattacaactcaaggtgagatttaggtagggacacagccaaaccatatcagcaactcaaatgcaatgataaacctgccgttttccctataaataatcctagattcattccccattttgagaatgggactataaattctatggttacataagccaacctggtcattaaaattccaaattttctatatattttttgccaataattatttttaagttcaatagcattcataattattctcccacccttattgccaaaataccttttttgtttaattattctgaacaaacctgactttgccatttcttacgatgtagtcctaacccctccagttgtacactttggttgctatcagagtgaacatagcatgatgacaattcctactcaaactttttaaatggctcccccatttaagaagtatgtaatgtatagtatatgtatatggcagcaatatgtaaatatataccattttgcattttacataggattaattattctctggctcccactcacctatccaaaatcaagtgttctttctgctcacttcatatcaaaccccatgtctccataataataaattatgtctactccacctccccatccctcagacctttccattacctaagtctgtgtatatgtaatattgtctctgtctacaatgacagcctacatattatttacaaggaagacacttgatctttcttcaaatttctaattacaactcctctacttcttcagagaggtcagaagacatctttttctatttttctatattgcttctgcatgtttatatttataataaagtaaatgctcagctatatttatattcaggggtagctaattgagttgagatattacactcaattaatgtatactcaattaaatttagttttatattaaaatttatattttatttgggaaaaagtatagttatgaaataagaagacagatcctgattttggcaggggttttccgagtacatgattgatagattcgcatatttgtgtattcctccctaaaatagtcagctcagcgttacatggatccaattcttgcctgtaaccatttaagaaagaaatggttttagtataagtcatataaacatttatctgacaaattaattaaactattatcaaaagaataatttaagtaaatagattatttcacaataaaacaaagccagaagcagattaatctgttataaattagaatccttaatgctttaagtacataaacacaaagttacagtttgacaaaacaacaaattatagcaatcaaccaatgaaataaataaatcctgataaacagatctttctcaattgtaactgaaacaatgatggattataatattccattttagctttttacattattaaattttctgtatgagtgaaaaatattaaaaagaatcaaatttcaatgcagtcatacagtgtacaatatatacttaggtggaaaacagatatattgcagacagtaattagttgtagaaatataaattataccaataagcaaagcacagaaaaattaacaaatgaataaatcaaatataacttaattagggagatcagagtaataatttccatatgcccattcttttagaaagatgaaaaagacaaaatactttgtcaatactttaacatgtagatatgcatgtgtcatttactctagccatatgtttaactaattgtttaatccagagattggcaaactataccctaggccaaatcttgcctgtcatctctaagtaaataaactttaattggcacacagccatatgtttctttacatatagtctatgggttttttcataacagaattgaataattgaaacaagactttaagtcccaaaagcccaaaaatatttactatctaacccttatagaaaaagttggtagatgcactattcaatttatctattaaccaagcaagtaagctttatcataatccttttcaaaataatagtacacattcttgggaggagccaagatggctgaataggaacagctccggtctacagctcccagcgtgagcgacgcagaagatgggtgatttctgccatttccatctgaggtaccgggttcatctcactagggagtgccagacagtgggcgcaggtcagtgggtgtgcacaccgtgcgccagccgaagcagggcaaggcattgcctcacttgggaagtgcaaggggtcagggagttccctttccgagtcaaagaaaggggtgatggatggcacctggaaaatcgggtcactcccacccgaatactgcgcttttccaacgggcttaaaaaacggcacatcacgagattatatcccgcacctggctccgagggtcctacgcccacggagtctcgctgattgctagcacagcagtctgagatcaaactgcaaggaggcagcgaggctgggggaggggtgcccgccattgcccaggcttgattaggtaaacaaagcagccaggaagctccaactgggtggagcccaccacagctcaaggaggccggtctgcctctgtaggctccacctctgggggcagggcacggacaaacaaaaagacagcagtaacctctgcagacttaaatgtccctgtctgacagctttgaagagagcagtggttctcccagcacgcagctggagatctcagaacgggcagactgcctcctcaagtgggtccctcacccctgaccccggagcagcctaactgggaggcaccccccagcaggggcacactgacacctcacagggcagggtattccaacagacctgcagctgagggtcctgactgttagaaggaaaactaacaaacagaaaggacatccataccaaaaacccatctgtacatcaccatcatcaaagaccaaaagtagataaaaccacaaagatggggaaaaaacagaacacaaaaactggaaactctaaaaagcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgaatcaactgaaagaaagggtatcagtgatggaagatgaaatgaatgaaatgaagcgagaagggaagtttagagaaaaaagaataaaaagaaaggagcaaagcctccaagaaatatgggactatgtgaaaagaccaaatctacgactgattggtgtacctgaaagtgatggggagaatggaaccaagttggaaaacactctgcaggatattatccaggagaacttccccaatctagcaaagcaggccaacattcagattcaggaaatacagagaacgccacaaagatactcctcgagaagagcaactccaagacacataattgtcagattcaccaaagttgaaataaaggaaaaaatgttaagggcagccagagagaaaggtcggattaccctccaagggaagcccatcagactaacagcagatctctcggcagaaaccctacaagccagaagagagtgggggccaatattcaacattcttaaagaaaagaattttcaacccagaatttcatatccagccaaactaagcttcataagcgaaggagaaataaaatactttacagtcaagcaaatgctgagagattttgtcaccaccaggcctgccctaaaagagctcctgaaggaagcgctaaacatggaaaggaacaacccgtaccagccgctgcaaaatcatgccaaaatgtaaagaccatcaagactaggaagaaactgcatcaactaacgagcaaaataaccagctaacatcataatgacaggatcaaattcacacataataatattaactttaaatgtaaatgggctaaatgctccaattaaaagacaaagactggcaaattgggtaaacagtcaagtcccttcagtgtgctgtattcagaaaacccatctcatgtgcagagacacacataggctcaaaataaaaggatggaggaagatctaccaagcaaatggaaaacaaaaaaaggcaggggttgcaatcctagtctctgataaaacagactttaaaccaacaaacatcaaaagagacaaagaaggccattacataatggtaaagggatcaattcaacaagaagagctaactatcctaaatatatatgcacccaatacaggagcaccaagatccataaagcaagtcctgagtgacctacaaagagacttagactcccacacattaataatgggagactttaacaccccactgtcaacattagacagatcaacgagacagaaagtcaacacggatacccaggaattgaactcagctctgcaccaagcagacctaatagacatctacagaactctccaccccaaatcaacagaatatacatttttttccagcatcacaccacacctattccaaaattgaccacatacttggaagtaaagctctcctcagcaaatgtaaaagaacagaaattataacaaactatctctcagaccacactgcaatcaaactagaactcaggactaagaaactcactcaaaaccgctcaactacatggaaactgaacaacctgctcctgaatgactactgggtacataaagaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatgcaaaattgacaccctaacatcacaattaaaataactagaaaagcaagagcaaacactttcaaaagctagcagaaggcaagaaataactaaaatcagagcagaactgaaggaaatagagacacaaaaaacccttcaaaaaattaatgaatccaggagctggatttttgaaaggatcaacaaaattgatagaccgctagcaagactaataaagaaaaaaagagagaagaatcaaatagacgcaataaaaaatgataaaggggatatcaccaccaatcccacagaaatacaaaccaccatcagagaatactacaaacacctctacgcaaatactaaagtagaaaatctagaagaaatggataaattcctcgacacatacactctcccaagactaaaccaggaagaagttgaatctctgaatagaccaatagcaggatctgaaattgtggcaataatcaatagcttaccaaccaaaaagagtccaggaccagagggattcacagccgaattctaccataggtacaaggaggaactggtaccattccttctgaaaccattccaatcaatagaaaaagagggaatcctccctaactcattttataaggccagcatcattctgataccaaaaccaggcagagatacaacaaaaaaagagaattttagaccaatatccttgatgaacattgatgcaaaaaacctcaataaaatactggcaaaacgaatccagcaacacatcaaaaagcttatccaccatgatcaagtgggcttgatccctgggatgcaaggctggttcaacacatgcaaatcaataaatgtaatccagcatataaacagagtcaaagacaaaaaccacatgattatctcaatagatgcagaaaaggcctttgacaaaattcaacaacccttcatgctaaaaactctcaataaattaggtattgatgggtcgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaatggtattcatttaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagcaaacagagagccaaatcatgagtgaactcccattcacaattgcttcaaagagaataaaatacctaggaatcaaacttacaagggatgtgaaggacctcttcaaggagaactacaaaccactgctcaattaaataaaagaggacagaaacaaatggaagaacattccatgctcatgggtaggaagaatcaatattgtgaaaatggccatactgcccaaggtaatttacagattcattgccatccccatcaagctaccaatgcctttcttcacagaattggaaaaaactactttaaaattcatatggaaccaaaaaagagcctgcatcgccaagtcaatcctaagccaaaagaacaaagctggaggcatcacgctacctgacttcaaactatactacaaggctacagtaaccaaaacagcatggcactggtaccaaacagagatatagatcaatggaacagaatagagccctccgaaataacgccgcatatctacaactatctgatctttgacaaacctgacaaaaacaagaaatggggaaatgattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctgggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaactgacaaaatgggagaaaatttttgcaacctactcatctgacaaagggcttatatccagaatctacaatgaactcaaacaaatttacaagaaaaaaacaaacaaccccatcaaaaagtgggcgaaggatatgaacagacacttctcgaaagaagacatttatgcagccaacagacacatgaaaaaatgctcatcatcactggccatcagagagatgcaaatcaaaaccatgatgcgataccatctcacaccagttagaatggcgatcattaaaaagtcaggaaacaacaggtgctggagaggatgtagagaaataggaacacttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacgcatgcacacgtatgtttattgcagcattattcacaatagcaaagacttggaaccaacccaaatgtccaacgatgatagactggattaagaaaatgtgtcacatatacaccatggaatactatgcagccatcaaaaatgatgagttcgtgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtcgggttggggggaggggggagggatagcattggcagatatacctaatgctagatgaggagttagtgggtgcagcgcaccagcatggcacatgtatacatatgtaactaacctgcacaatgtgcacatgtaccctaaaacttaaagtataattaaaaaaaaagaaaaaaaaacaaaaaaacaaaataatagtacacatattataaaagacacctacatagcatccaacaatcaatgccattctgttccatgaatatgtgacattctggttttcatatatttatattgaattatggcatacataataaagagggtaaaggataaagctctatgaaatattatattgtgaacatagtcaagtaaccactacccaggacaaaaggcacaaaattactacctagactactccaccacaacatacacaagcatgcacacacatgcacagacacacacgcacacacatactctctctcacaactcttctatcctcattcaacattatgtttttgagatatatatttttgaattgaatagtttatttattttcaagatatatagtcagatacttcacaaattattctaatgttggtatactgtgaaattttaaattgttgagctatgaatagtgctgctatagacatgcttgtatgtattgtttgatgtacagaaatgtgcatttctgttgagcatttaacaaaaaagtacttagagttctatgttcagtatatgtgctctactgattatatattttgcaaggattttctttttactttgggtatcttactgttttagttttttaatggtgttttttaataatcagaagtttttcatcttaatttataccaattgatcaatcttttccttaataattagtattttgttgttgttcctgacttactccatttttgaaactatattttagtattgacatttagatctacaatccacctgagattggtttttatatagtcccaagtatgtatcagtttttattttttctctatggaaatccaatcgactcagtaacatgagtggaagaaaactatccattctccactgttctgcagtatcgcttctgtcataaatcatgtccatatatatgtaggtctgtttctagactctcttttctgttctactggtcaatttttctatctttgtaccaatatatcaatgtcttaagacttactctaaaagtacagtatttaatacacagtagagtaagtcctcctacttcattttttcccccttaacattgttttggctgtgtgtgtgcatgcatgtgtgtgcacacaagggtgtgtatgtgtgtgtattcctgggctctctctcttttattggttcatatttctacctttgtgtcaatattacactgcctgatactgatactgcctaatgctaacgccttataattattgatattttgtatagtaaattaccttactttgctcagtttttttaattgagataattaaatatctctttctttctctcttatgtgtaatgaattatgtttgctggttttcaaaagtttgggtgtattcttggagtaagtttaacttggttatgatatatggctttcttatataacagtggatttacttttccatatgttaaggaatttttacatacagttaataagggatagacctttcaatttcaatccgtgtactgctctggtaagattttagtatcaagcctatgctgtcctcacattcagaaagattgtgttacactgatgttatatctaccttttatgtatgatagaattcactagtatagcctactgggcctgaaattttctttgtgttttctttgtggagatgataaatatggattacatgtatttagttgatataaattatctatgatcatgtctgttttgtcacattgtattttttataggattttttaatctaaaatttcagttattggcaaaaatgtttcataatttccttttgttattggtattggttttggaactcccacatctgccattttttggtatggtatttggctaattgtgtcctttctaattttgttttgtaaatcaatgttggtagaaagcagaaaatttcaaagaacacacttttggcactgttgatagtctccattctctgttttctacttcattgacttctgctctttatgatttccttcctttaactttctctgtgctttatttactcttttgtttctaaggtttttaatctaacatgcgctttcaggatagaaaattttttctaaacataaatttaaccatattcaacaagttctatttttcattattatctgttcaaaatattttctaatttcctttgtgattgttttctttggcctcagtggtatttagaattgcattgtcaaattcacaaatacacaggtatttttctggtcattttttaatattctaattttagctcaaattgagattgtccagaaaatattatctttaaacttttaataattttataggtatttaataataggtattgaaggtagatgccaggaaaggccaagtaactgctgaacaccataaagttgtggctgacctacattgatattatttacatgcttaccacattattacacagcaagttttaaacttgaacacgtgttaggagacagaaggagagggattaaataggtcaatcctgtaaatgattctctttcagtaagaaacttgaacacgcgttaggagatggaaggagatggattaaataggacaatcctgtaaattattctcttttaattctttgaaatatgttgactcaggctgcattgcccagcatatggtcaattttaatgatattttcatgacactggaaagtctgttgtttggtgaagtgttcttgatatgtgaatattgtcaggttttacacacacacacacacacaaatatacacacgttcaaacatatttatccacatatacacacataccacaaatatacagacatccaaacacatttatccaggtttataatacatttagaataaatataataaaacagtgaaatcatgtctatgatgtatgcaccttttttcttcttgagaaaatatttacacatattcttcaaatcctcctatctgtataatgatataaacctcatagacctaagaccaggtatggtcatgcagccaactttggggctttgataaagaaagctttgacaattttttgaaaatatcaatgatattccctatgttaagactatgggagaaaaaatggttcaacatttttagaaaccactggatattcttggattctgtatttagaagcaaactagaagctttctgggttaattacttcttacaattaaactgttaaaaatatctgagggagaatatagcttccaggaagctattcattaaatgataaaaataaaaaagcacaactgctttaataattctctaaaatttaatgtttggaaaaagtttgtactgttttatgatattaaaatagcaacaatagttattcactaacactttgctaatgaactcatttcttataaatgaaacacattaagatatcaaatatatttatttgatctttgattatgacaactgaaagactaacataaaacaatatatatgaactctatgttttctttccttactatacaagcaatataagctcattataaaattttataaaaataaacaaatttacccaacatccacacttggcttttataattatatcaattgacctaaaatataggtcaataactatatatctggatttattttctggttttcaccattttctcttatatgactatatcactatttaagtgaatcccattattgtctatttagtttattttttgaaattatagaatcaccaccacaattatgtagtaattaatacttgggaagtcatctcacccttgtttagttattttctcataaggaaaatttattcactacagatgaattattgaatcaaattataagcaattttaatgatttgtcatcaaattgctggcctgctctgcaaactttgtacctgttcatctaaaacctacaattacataagccaattccttgaaataatttttttaatataagttttctgttagttctgtttccctggtaagaccctgactgaaattttggtacctgatgtatggagagtatcaagatgactgaatttttgactcattgtacaaaaatatctcttatattttcttatttgaagctgtgttagtgctgatggagtataaaatctgactttttaatcggagctggtcctgataatagtttctgttaaaatcacaattcatgtctctctcaaatagtattagctgcatggaattcagttccttaagattttctgcagaacagcaatggatcaggtgattagcctttgactatcaactctaagctagagaattgctatgatttttgaaataaataaatgaacagaagaaaaaggattttggggaaaagtgaatatatcatgagggaaattatttatagatatattgcatttgaggtttttccttgaaagttaggatttttgttattttagagaatttctattcattgtcacagaaggtagtcagcttcaccatcgggaatactattatctatataatagttgtgcaggttttcacctttggataagtatgggaatttttctttcatacttaaaattcttcatggttattcttgttttcaaagatattatcttatctgaaataaattacccattgtaaatgaatacaaggatggcacatcatcttttctcatacatatattcagagagctggcagctatgttgcaggaagatgaaaggtaagcacgcctccattatacctacgtaggccatcaggttttctttgtcatagatgcaattctaatatttcatctagcaggttgttattttattcaagaggcacactttttaacagcagttgtatctttccccttaggcttattagagcagaggcaatcttgtgctgattgtgctcgattgaatctgactgaacatagaaaaacagtcctacaacattattgtttagcatttgctgatgaacagtttgcttagctcaccatgcagtgtaaattttttccatcaaggctttttaaatgctttctctaaaatcagcaccgagggtgctttaaaggtcaaatgagcagaatagtttttcttttttgcataattgtatgtaaaactctcttgaggaccactggtgtttgaactacctttaattgttcttccaaacttacagtgattgttcaggtttgtcatttggactgacataacggtaatcactaactactctccactaaatagagtatggaagaaaaatttagtgagccatgaattctatccattaagtttatgtattcagagtagatgcctggaaaggtcaagtaactgctgaacaccacagagatgagggtgacctactgtgatattattcacatagctactgtatcattacacagcaagttctaaacttgcacaggtgttagcaaagactaaggagatagatgaaataggcaaattctgtagataaatattcaaaaaggcagaaaatagcaaaattccatcgtgttggaaatcaactctctcatctgatcatttttgagcattacaatcgtcaaccttcagaaattactgactcaaatcttaagcttaacaaaattgttcttaattgaaagcaataaaccttcctataaaacctgagtatgtgtgtatctactttgttgtttatcacatttgcattaaaaaattgattccatcagtcataaaaatataaaggaattagtatgaaataaaagcaaatgtatgcttttaagaaagattcaggcctgtaagttggctattcccacaaatataaataaaaattataaacatcaacttagatttttgatgaagacacactttttttattgatacatgatacttgtacatatttatgggctacatgtgatttttggggcaatatttttatcttaacaaattaccccatatatctacagatattttatatttaagtaaatataaaatatattcattagcttaaaaatacttattaaactgcaactacaaattgatttttaaagggatttaaatagatatagtggatatttctgttagggagacttattcaattctcatatttattcaagtaatttccacaggtgacatggaactgtccccagattccactatatcttgtcatatctctgaaaaacttaaaatgaatttcctcacttaaaactttgaatggtagactattgccaaaagaattaagtctaaacacgttcatttggaattcaagtccccatgtttcctgtttaggcttttcttatttggttatctatatctatgacagctcaacaacagaaattttatgctgtacttgtcagtctcttagttatcttaccatgtccactcgtctatgaattcttctggccctttgctgaatcctgtttccccacttgccaaggtttttattttgccaactgatatattacttataattaagactttatctaagatccacctattacctaaaaagtttctaatatttgcagtcttagtgatctctttaatgtctaacaccattaaagtgtgccactcatttttgcattcaattacatattgctttctccttttatgtgattgtatgatatttatgttttgtttctccagtaaaaaaataacctctcaattggcagagttgtgatttatccatctttgatttcttaataaaacttaggcttttgattaaggacttagaaaataaaattttgagttttagttgataggaaaaactgtgttcctagaaatgtaccacatattcccttctatcctaaataaatgtgtttctaaggtagtgaccttttcatttgcaggaagccatcaagttgctaggtgcttaaatggcacctccttctatcacagattgcttctggtctttatgttaggatcagatcattcgtttgcccatggggcttcccactggcaaagtaactgtttgcattcattgagcactagtcagatttcctaacattgacaggcaattgaacaaagattagctaaaaattttgaattcaatattaaaaataccatgcaattcaattgttctctggcaaattctaaagtaaagattattctggttgatttttttcttttagggtacatactcttaagaaccgtgtaaatagaccttctttttccttttgtgtttgtatgtgggacaaaaaatatttccatatcgtgttatgattcttctgaaaggactgctagaacttcagatctttccactgaatagattttaaaatatgtttttgcatttgtgattgagattaattatcagtgatatggttaatactccacattaatcattgtgattctaattatattatatttcaggagctgtaaaacaatactcaataataaaataattgacattagattattaaatactaagatcattgaaaatttaatcaagaacaatatatccaattatcgttatcattataagcaattaagccacatctagtaatattcccttgagataaaatatagactttataaaaagaaaacaccaagagaactaggttaatttagcatacatttatattttatattatttggcaaaattgtgtaaaaatatttaaaaatatggtacttgacaatttatgaatattcacaaaatatgtctgaaattttatttttcttaatcattaaaaggataaaaaaaacaaagtaattttttttttctgagatggcgtctcgctctgtcacccagggtgtagtgcagtggtgcaatcttggctcactgcaacctccgcctcctgggttcaagcaattctcctgcctcagcctcccaagtagctgggattacaggcatgtggcaccacgcccggctaatttttttgtatttttaatagagatggggtttcaccatattggccaggctggtctcggactcctgaccttgtgatctgcctgcctcagcttcccaaagtgctgggattacaggcgtgagctactgtgcccaccctgaaagtaacttttaaatttaatttgctagatacttttcttcctatcatgggcaatcctgaaaagaatattgggtcatgttgtgaacacctccaagccttcctcagatcagcaagaacaattcaagaaaacaccagaagtagaggtgataaagcaagactgcttatgtagagaaataaagggaagatcaaaagacaccttcaaaatgacatgtgtaatgcaattttcctctgagaaactggattttttcagaggaaaatccagttttttgttcgtgaatccaaaaatcagcccactgggtggctgagatgttgggagcttgtgtagggcttaccttgaaagtgtatttcttatattctgtgctgggggtggttagcctattacagtttcaagagtgatggctatttaattatgtaaaattggggagtaaatccctagtcagattagtcacataattaagtttgataaagctcaatattatagttgggcatttttagctcaatctagttgcatatccacaacaactcataaaatctattagccttcaacaatgtcactggagcttttaggttactttgctttaacacatgagggataaaatagacaatgaggcatactcatttgaaaccatatatgctgttgattcatctgaatttaatttcagaaacacacaaattatttttgttccctagtcctttttctaaattgtaatatagagtgtgagagtgtgtgtgtgtgtgtgtgtgtgtgtgtgtgtgcacgcacgcgtgtgagcttttaagaggaaatagggaaagcctggtctttggagtaagaaaggctccatttcaaatcccagctttaccatttattatctagcagaattttactttttatttctcagataggtattttaaaatactaccacgtgtcaggcaagacagtccacgctggatgcaagattaacaaaacagcattagggtccttcttttgtaattcaaatctcaagggagaggacaatatgcatcaaacatcaagatgcttaatggggttggggactgatttaatctgaaatgtcagggaacacactccaaaggaagtgagatttgagatggagtctaaataataaataagaatcagtggactggcagaattaggtaagagtgtgccaggcagagggaacagtatatacaaaagttcttgggggcagaacgtaagaaggcatgagttgaaataaatcctgaagaattgatgcagaatcataccatgtgtgggaacattgatggggaaaatgggattagagaaaaagtcaaggccacttaactttttttaacactcttatttattttattttatttattttaaagttctggggtacctgtgcaggatgtgcagatttgttacatacgtaaacgtatgccatggtggtttgctgcacctatcaacacatcacctaggtattaagcccagcatgcattagctatttttcctgatgctctccccgactattcccccaacaggccccagtgtcacattcagttttcacatccatgaagtgacatgtctaaagttattgctaaaaatgtatatcttaattaacccatcctttcattgtcaaataggagacttgggaaattagaacaaagttaggtgttcagtggatgttagttttcttcttaaagggagtttgttttgttctggtttggagctatttatgacaaacccacagccaatatcatactgaatgggcaaaaactggaagtattccctttgaaaaccggcacaggacaaggatgccttctcttaccactcctattcaacatagtattagaagttctggcccggcaatcaagcaagagaaataaataaagtatattcaattagcaaaagcagaagtcaaattgtctctgtttgcagatgacatgattgtatatttagaaaacgccatcatctcagcccaaaatctccttaagctgataagcaacttcagcaaaatatcaggatacaaaatcaatgtgcaaaaatcacaagcattcctatacaccaataacagacaaacagagagccaaatcatgggtgaactccctttcacaattgctacaaagagaataaaatacctaggattcaaacttacaaggatgggaaggacctcaaggagaactacaaaccaatgctgaaggaaacaagagaggaaacaaacaaatggaaaaacattccatgctcaggaataggaagaagcaatatcgtgaaaagtaatttataatttcaatgctattccccatcaagctaccattgactttcttcacagaattggaaaatactactttaaatttcacatggaaccaaaaaaaaatcccatatagccaagacaatgtgaagccaaaagaataaagctggaggcatcacactacctgacttcaaactgtactacaagttcacagtaaccaaaacagcatggtactggtagcaaaacagatatgtatagaccagtggaacataacagaggcctcagaaataccaccacacatctacaacaatttgatctttgacaaacctgacaaaaacaagcaataaggaaatgattccctatttaataaatggtattgggaaaataggctagccatatgcagaaagctgaaactggatcccttccttacatcttatacaaaaattaactcaagatggattaaagacttaaatgtaaaacctaaaactataaaaaccctagaggaaaacctaggcagtatcattcaggacataggcatgggcaaagacttcatgactaaaacaccaaaagcaatggcaacaaaagccaaaattgacaaatgggatctaattaaactaaagagcttctgcacagcaaaagaaactatcatcagagtaaacaggcctcctacagaatgggagaaaatttttgcaatctatccatctgacaaagggctaatatccagaatctacaaagaacttacacacatttacaagaaaaaaacaactccatcaaaaagtgagcgaaggatatgaacagacacttctcaaaaaaagacatttatgcagccaactaacatgaaaaaatgctcatcactggttattacagaaatgcaaatcaaatctgcaatgagataccatctcatgccagttagaatggcaatcattaacaagtcaggaaacaacagatgttggagaggatgtggagaaataggaatgcttttacactgttggtaggagtataaattagttcaaccattgtggaagacagtgtggcgattccttaaggatctagaactagaaaattgacccagcagtcccattactgggtatatacccgaaggataataaatcattctactataaagacacatgcacacatatgttcattgcagaactgttcacagtgcaaacacttggaaccaacccaaatgcccatcaatgatggaatggataaagaaaatgtggcacatatacaccatggaatactatgcagccataaaaaaggatgagttcatgtcctttgcagggacatggatggagcaggaaaccatcattctcagcaagctaacgcatgaacagaaaaccaaacactgcatgttctcactcataagtgggagtttaaaaatgagatcacatggacacagggaggggatcatcacacactggggcctgtcatggggtggggggctgggtgcgggacagcattaggagaaatacctagtgtagatgacgggttgatgggtgcaacaaagcaccatggcacatgtatacctatgtaacaaacctgcacattctacacatgtaccccagaacttaaagtataatttaaaaaaggaataaaaagggttcatcaattaatatggaagataacaccatttatggcaaaacagaggtgctggaatatcttggtatacttgatgctaatgaaagaagtggggcttctaattcctcacaggtgatattaagccagattcagtactatacaaatataaattgttttcaaggaatgttttatatgctattttaagaattagatacatacaatttaaaatataactatatggtattagcatatatatgtacatatatgtgtatgtatgcacacattattatcattattattttagaggtggagttttgctcttgttgcccaggctggagtgcaatggtgtgatcttggctcactgcaacctccgcctcctgggttcaagtgattctcctgcctcagcctcccgaggagctgagattacaggtgtccacaaccacgcccagctaattttttgtatttttagtagagatgggctttcactatgttggccaggctggtctcaaactcctgacctcaggtgattgacccgcctcttcaagtgctgggattacacgcatgagccacggcgtccagccgcacacattatttttttttaaaagggaatacataacagaggtttaccataaattatctttggagtattatttctccttattctgctctaaacctttggagaaggaatggtttaatggaagagcaaatggagaataaataatgagttaataataaataaataaataataataaataatgagtaataagaaatgttttctcattactatgtgtttgaaacataatgctttatagttcaaggcctgtaagacctttagatataaaatataaatgtgattgtgactgctacataaaagaaagaaaaacattaagtcacactatgcaactcagcctccctccaatcacctgaggagggagagaggatgcctaagaacaacatgaaggacaattctgtgaccaaatatttttaagtacgctggtacatatatttccacagttttaaaaatctgaatgcttaaaggaggtgtatatctgggaaagtagtgattccaagacttgagccccagctggggtacagggatagtataaatcccaacacagggtattctcctaaaactgagtttgtcttttctagaaagccctgcataacatgtatttctgtgagaaaaaatacaatatagaatgtattcattctcctgtgagaagagatacaaaaaccaaacttctgtagtgtctgtagggtacagagaattggtaaactctgaaattataccatagtcaatatgactcttttgttttttcttccaacttgtattaggttggtgcaaaagtaagtgtgatttttgctatgttgagggcatacatgtgcacgcttgttacatgggcaaattgtatgttgctggggtttggtgtacaaatgactttgtcacccaggtaataatcatacaaaccaataggaagattttcattcttcacaccctcttcccattctcaaccttcaagtaggccctgtgcttattgttctttttgtttccaagtgtactcattgtttagctctcacttataagtgagaacatgttgtatttggttttctgttcttactttaatttgcttgggattatggcctccagctgcatctatgttactgaaaaggatgtgatttcattcccttttatggctgcatagtattccatggtgtatatgcaccacactttctttatccagtccactattaatgggcatctaggttgattccatatcttttctattgtaaaaagtactgcaatgcacatatgactgcatgtgtttttatagcagaacaatttatattccgttaggtatatacccagcaatgggattgttgggttgaatggtagttctgttttaagttctttgagaagtcaccaggcatgccagactccaaaagcaattgtaacaaaaacaaaaattgacaagtgggatcaaattaaactaaagagcttctacatagaaaaaggtgatccttgagagcataacacagttttgtttctttttctttccattcaaagagctggaagtttaatctagcaaaatgcgaagcaattcttaccaagacatggccacaaatagaccatgccactggtcatgaggctttggttgaactaacttcaccaattttatatgttgattattagaatctgaaaaaatgctcttattattttgggcgcattggcttgtttcagaaagtagaaagcaaaatgaaacctgagtaaaggtaagagatacatggtttttgttcagggaagctagtaacacacactatggtaatttgttgatatatcaatttatgttgataggtctatagggtctcaagtacatttatgcacattttgataaatctaaatttttttaaagacatgtactatgaaagtgctcttagtgaggatttatttgggagacaaaaggagggaaaacaaattaatttatttaggggtaagtttatattttatatagcctgggtttaaaaaatccagcactacctttaaaagtaactagtgattcttatcagtagaggggaacacagacgagttactcttggggcatttataattgtaaaaattagggcattcatggactcttaagatttaataggactgtgttagtgcagataaaaaaagagattcagggcatttaaccaggcaggacccatgagtctgtgaattaacacaacattttagggtcctggctaacattttatctttgcatccaacagtcagattctgttctgcagcattccctgatggctgatggaaactcaagttaaaaataaaatctgatttattatattttcttaccatggaatgagagtgaatcctcaaaatagtatctgagactgaatatgatttttattatacctagtttcaaggttttactaactgaaaatgagtcgcattgctatcttgtcactattgggaatcttcatgtccaatgagccttttacttccactgaagcaagaattgaaactgtctctaaggggaaaagatggctaataatcactgccattgaaagacaatcttagttggatttaaatgaaaactaaatattttttattatctggttccaaatgccattctatctttctttcacagtcatatttaaatctaagaagcccaattcattgttgtgtgtatgtatttgtgaggaaagcatgtttataatattttcataaaacatgaaaaattctgtctttgtcttttagagtaatatgacaaataaaacacatcaactctagccagaacattggcttgactgaaatattacatggtcaccctgatgtgtatatattggtttttactgtgtgtctatgtactctcacctactatgatgataaactttctgtgcactgttaaaggacactttctttcctcagacaaaatctgtaacatttatgctgagtgaaaaacattagaattttggatactcaaaatttttagttgggtagtaatctttattttaatcttggttttaactaccagcataaagtttaatcagcttttaagaaaatgtggactgttttaagtctttagaagctcaagatgaatgattttacacattacaaagtgtatgtgtggggataatcaggagagaaacactgaatcttccttaaagggatgttgaaaagccatagttctatttttaagtatgacagctatttaatgatatattgaagattttatataaaaattaacctgaccattcacaaattataaaataatggtttatattagaagttagagagaaaatgattacaatacagcatcatataacaccatataggagaaaaatcttgacaatccataaaacataaaacagtaacaagcagaacacaaattattgaaattaggttaaagtctctcaaatttggagaattaaataaaagacacatgtgagaaccaatgactcagaagtaagttggcaaagttagatcatacaaatggaatccaaaaaatcaggtcaagcattagcattcagtagcaatcaaaattcaaaacagaaaataagacaattaggctcatacatttataaaagtcacaaagcagtttaaatatataaaataggctgagtggcatggctcaaacttgtaatctcagcactttgtgaggctgaggcaggatgatcacttgaggccaggagttccagaccagcctggacaacatagtgagatcctaccaatatacaaaagtttatttcaaaactagccaggtgtggtggcttgcacttgtagtcctagctatttaagaggctgatttaggagacctccttgagcctaggagtttgaggctgcagtgagctatgattacgagtgtatatgaatatacacatatatgagatacacatatatgtttgcatatatgtatatttgtatatatgtatgtaatatatacacatatatatgtatatatgtttatatatgcatgcatgtatgtatatatgtttatatatgcatgcatatatgtatatatatacaagtatatataaaatgataaatgtgtattagtaaaatctgttatgaattcaagaggaatgaattgatatccaaatatagcctagaaatttaatacttcattactagattatgaaataaactgaaaaaataaataatatagaacatttgaaaaatatggccaataaaatgtaattaaaatctatatatcaaaattttgcctatacacagaatatacataattttctaatatccacagaatattttatatttgttttatattttgcaatcaataatattttggtaaattttactaaaagcacacaaaaattaatcattctttgacaaactagtgtaagaagttttaaagaaaaaatgtgaatagcctatttaaaacaattgttcccaaacaaataatgaagaatgaggactcaggcaatttagactgaggagatcttgaaaggtctttgttagtatttatttatctaatgctgtgtctacctaattatatcagatgaatattggggttggtagagatatataggaggatgcataagtatagaagaaaaggagaaggcatttgagatgctgaggatgttaataatggcaaatttgtttttcaaaaatagtaaaagttgatgtctagtaatatactcatttaaaaattttttttctctcttttcctgaggaacctcaagtgtgtcagctgtgaagcatgtactgtattcttctggtggaaattagcatggccactatatcacaaatggatattatcgcaaaagttaattgtattactagttctgtttaaagataaagaatcagacatgtgcaattatcttctatcacctctgcttagtgagattcaactttctttttctttactatgaataaaacaaactaaaaattcacaaagatatacaaaatgcacgtgtatataagtggatggtaaagttaaaaaaaaatagagacaaaattttggatggagaagtgctaactaatttagccgaatttatgatgcatgcctgtggaggaggatactagtagaagagagccagcttattccacaaaactgctaaaaggccaaactcctatacaggctgcaaggagcaggattaaaactatggatactagttgaagcttatgttcagggcaagtaaattccccttcctcaccttgtgcagccatatattccccactctcccttaaaggagattagatatttatcccctctactctgccatagttttggcagtggttctgattctccaccctccaaactcctgtcagatagtgccttctacagagctccaagatctaggctatggtcatacttcctccttctcaggcctgcagttggtaatggcttctcagccatcattagtctcccgatgcttcccttgccaatgtccaaacatctataaattatcttttcattaaactctgtttaagccctttgagtataaatgtatttgtctccatctgggaccatgattgatacatcagagaacagacaaaatcttcaaaaaactgtaattgaataatatcctcagggagaaaacagaaggctattcttgtccaaacaacaacaacaacaacaacaacaacaacaacaaaaacccaaaaaaaaacctcccctcccaaaaaaaaacagtatcaggaagaacacaaagtacagaaaatatcgtaaaggttaggacaaaagataaaaatatagaaaatcaatgaaataatttaagggactaagatactagtactgctgtaccatgccacaaaggcttatgggaatccagcagagtgaaagataaaagaaaaacactaagtacatgctatggtctaaatatttgtgtcttcccaaattcatatgttgaaatcctaacgcccaagttgatggtattaggatgtgacatgtttgagaggtggttaggtcatggaggcagattcctcatgaataagattagtgcctttagaagaaaagtctgagagagaccattcaccttctccaccacataaggacactatgagaaggcgtcatctctgaaccaggaattttgcccttaccaatgactgaatcagctggttcctagatcatgtacttcctagccttcagaactgtgacaattcattttctgttatttataagctacccagttcatagtattttgttacagcagccaaaatgaagtaagattgtacaactttgtgaaatttcaggagactaaaaatagagaagaaaccttaaaagtttcctgagaaatgaagagaaattaaaagatatcatatacaaataaatatctgaaagttattagatatttcataggaacacaggatgctagaaatcaatggagccatgccttcaaaattctgagggaaatggttcacgttttgtgtataaatttgtgtaaaattaagtttgagggtagaacatctagatatacataaagatgtggcaagattgtcactttccaggcagccttgattcaaaaacctaatatatactatgttccagcatcttatatcagacaaatgaaacaaaataagtaagagaaaataagacattcaataaccatttggccaaacatagaagaatagcaaagtgaagtttcattgctaggagccataaagtaaatctcatgaagagttaaaaaaagataagcataataaaattatgcaaataataaacaaggacattatttactgggcagagggtggtgaggttataagaaaaggaaagctcactgtagtataatacttggctgtgccaaacatcagcatatgccatttataatggtttatactttgcccgttgcttttcaaacaatggacctaattttggggatgatcaagcaaaacaatcagggttgatgtaagataggtaaatcctcattcttcataacaaaaagtcagtgataattttggaaatgaatacataaaaatagtaaaacacactttttacttggaagtatgaatattgagatacagaagaaactcctgaaaatatataggtaattacctttgaaataaagtaggatttggagaggatgagtatgtctctctctaattttctaataaaattacagatgactttgatataaaatccagtgcaaaaatgcaacaaacacaatagttgtatgaacacaaacacaagaataggcaatatgtgactagaagaaccacactggcgaagaaaaaattctgggtgttgccaaccaacaactacactaaatggattgtagcacctttagcatctggtggcaaccttggtggtgtttgaagtacactgagagccacacaggtgtttttcatgtaactataggtaaattcatttcaaacaacaacataggccttatgtctttggacacagaaagcacaagttccacaaggtcacatggcacccctgtattttcaattctgctttttgtgatgctctaaaaaacaataaatgttttattcaaactgcatctatgtagcttcccagtcatggcatcactggccatgtttatttgagactaaatgtcatcatggtttacattctctctgtcctaatagagaattactcttggtgagaacatcaagcatgctctgcctgtatcacattgctcttggatgtgttatgaatgagtctgaggcccattctgagggtacaatgttctgtccatatgcattaagagtaaatgcttcagttactgggagaagttcatatgttccattattttaagctgcaaagtgtgggattttttattgacctattttgaaagtatgcttactcaataaaaattgctagtgattttgcagtgttcttcaaatcataaggcataaagctagatgtttttaattgcactttagcatctcgtaaggaaatgctctcaagcctcagacaaatggtaagctgttgtattccctttggaaaaacttcatttgattatagtagtatttctctttctcctaaatattaaaataaagcaagctgaagtttctaagctttatagaaactatcacagagagttttgtctttcctttttaacatattggacaaaaactgagcttaatgtataaaaggctactttcagcaaagctgctcgtgtgctattccaaaagaagttggtctctccttggaaaggatcctagaaaactgaattggaggcagattttttggctaccttcgcacatgaatttcttcagagtagtggcagaaatcaatggcttccttaaataaagcactccagggacagaagaaatcatagcctggctcagttcctggaatttgtgtttttgcttgtatgatcattacttagcaagtactttcaaagtcaaatccctttttctacatttataatcaaaaagaataagaacctaaactcagatataaaattctgatgcttaaagtaattctcatcctggtgttatcaaatcttcattttctagtctcatctatggcagctgagcttatgccaaattaacaagagcagcagtaaaccactcaatttctgagcttattaaaattattccatattttagtgtatgtgaatgcatctctgcatgagttttatgagttctttataagccgttaggtctttttttttttttcttttcctctggtttgttttgtcttccttatattaactcatttattcacacttaattcattcatttattcattaggcaaaacttcataagtacttaatgtttatcactcaccatagctaagtgctaagaaattggaggtttaactttatttctgcatttttattttgaacttttttgagacattaatggtacatcttagtaaaattttctaagttccatccaggcacttgggtaaattttccaaatattactcagcataatatggctgtccttaggtaaaagataatgatacataacaaaaaattatcaatgttgataacctaataataatcttattagctaacatttattaagtgatactaaatggtttcacctattttagcttttctgatcctcagtaaacccaggaaaactgagaagttgtgggacttgacccaaattgcacagcaagtgatggtggtagtagaactctggttgtccaactcaagaactcattcttttcaagacaacattgtacggtactgcaataataatgacataatgttgactgaaccattacttcatggtcctggacacagtggtatgataattagagcttttatacattacagtgaaaagctatacacatatatttgtaattttaaaatgctcaagagtaaaaacaattacaaacatttattgagcactttctgtatgcaaggcatatgtagtaccttatactatatgaaaaattaccctctgcagcaggtattattattacctgcatttaacaaatgagagatttaaggttctgagttctttggtaacaggtacaggggtttacaatgggtagcagtgctagaatttgcttttaatttgcttgtttccagaaacttgttttaattggtatgctttacttcctctcttaaaaagtgaaaaccatttataccttatcaaaatagaccatttagatacatattgttggtggtgaattagattgcattgaataatgacaagtttctgacaattataaagcagtgacattcaggaagaattttttttatttagttgcatactagttattatttcaggaataatattttaaaaatctagtttttcaactctagcaaataatgcatattcttacctgtaagggttggctttttttttttttttttttgacagcgtctcactgtgttgcccaggctggagcgcagtggcacaatcttggctcactgcaacctcggcctcctgggttcaagagattcttctgcctcagcctcccaagtagctggcactacaggtgcacaccaccaagcctggctaattgttttgtatctttagtggagatgggtttcaccatataggccaggctagtcttgaactccagacctcaagggatccacctgcattggcctcccaaaatgctgggattacaggcacgagccactgcgcctggcctacggtcttgctattaatattattcaaattaaaatatttataacacaacaatgtttttcaaaaatgttttcatatgattgtttagattccagagtggtgacataggagaaattttaggggagacagggaaaccacagggtggggctaatagttccctacccaactcttcctattatctccaatccaggtctcaaacagaagaggctatcctttaattatttcatactgtagctatctacgtaacaccttgtttaaaaaaaaataactctctgcaaatttgtggtatggctatttagttcttcatgattgaatacacttgatacatattaaagtatgtatcttaagaagcttcagagtaatactttggaaaatcacaacctttttattttctaataaccagttctatgctatttcttatagggcagaaagcactaaagtgagttttttcttgcctttaagtctaaaggagtctttcctgtgttctgccctctgtgtgttcgaatgagaaaaccaggcaaaataggtctatttcaccagagaccagtgtgatcagatcacattaatatctacgtgattacctgcaccatctatgccttggcactgtcataaaatcacagggagagagaaggaaactctcattgactgaaattgattttctgttatctcatcagaatggggactagaaatgtaaattaagttgagatgtagaaaataaaattatatgtcttgcatacctgagttattggcagagattcctgtatgctgcaattggaatatatgactataattgagggaaggttctgtcccatggaaaaaaaaaagagtaagtttcaccagagtcatgctcctccactctattcccgactttggtttcaagttagatttatattgtgatttgatcacacagtccctgagaaaaggtgaggtatgctgtggtattaaggatgctttgtgaacggtggttaatattcaccaggtttctgcttccagaaatgtctggagtactgtgggggtgccagggtgtcagctgaactggaaaaatgcaagatcaaatagaacagccctgactctgactacaatttaaatattcgctatggctcccatctgagttcctcaaaatttcatcctggctagttccccacaaatcctctctatagacgatcataagtagctatattagtccattctcgtgctgctaataaagagatacccaagactgggtaatttataaaggaaaaaagtttaactgactcacagtttagcatggctatcatgagaatagcatgagggaaaccacctccatgattcaattacctcccatggggttccctccaccaagtgagaattatgggaactacaatttaagatgagatttgggtgaggacacagccaaatcatatcattctatcccgggcccctcccaaatctcatgtcctcacatttcaaaactcaattatgcctttccaacagtccctcaaagtcttagctcattccagcattaacctaaaagtccaaatccaaagtctcatctgagacaaggcaagttgcttctgcctatgagcctataaaatcaaaagaaagttagttacttcctagataaaatggcggtaaagggactgggtaaatacacttgctccaactgggagaaattggcctaccagaacaaagtccaaaatccaacagggcagtcattaaaccttaaagttctgaaatgatctcctttgaagccatgtctcacatctgagtcacactgatgcaagaggtgagctcccacagccttgggcagcactgcccctgtggctttgcagggtacagcatcccctcctggctgctttcaggggctggtgttgaatgtctgtggcttttccaggcacacagtgcatgttgttggtgggtctaccattctggggtctggagaacagtgtctttcttctcacagctccactagacagtgcccaagtggggattctgtgcggggtctttgaccccacatttcccttctgcactgccctagcagaggttctccatgagggctctgcccctgaagcaaacttctgcctagacatccaggcatttccatacctggtggaggtatgaaagatttcacacctagatttcatacctctgaaatctaggcagagctccccaaacctcagttctcgacttctgtgtatccacaggctcaacaccatgtggaaactgccaagacctggggcttacaccctctgaagccacagccagaactgtaccatgtgactttgagccaccgctacagtggctggaatgcaaggcaccaattccctaggctgcatacagccgggggagcctgggcctggcctatgaaccatattttcctcttaggtctctgagcctgtgttgggaggacctgctgtgaaggtctctgacatgccctggagatattttccccattgtcttggtgattaacattcagctccttgttacttatgcaaatttctgtagcaggcttgaatttctccccagaaaatgggttttggttttctattaacttctgtgcatccacaggctcaacaccatatggaaactgccaagatttggagcttacaccctctgaagccacagctagagctgtattttgtgactttgggcatcaaaggctgcatcatcaggctgcaaagttttcaaacttttatgccctgcttcctcttgaatgccttgccacttagaaatttcttctgccagataccctaaatcatctctctcatgtttaaagttccacagatctcttgggtagggacaaaatgctgccagtctccttgataaagcatagcaagaatcacctttattcccgttcccaataagttcttcctctccatctgagaccacctcagcctggacttccttgttcgtttcaccatcagcattttggtcaaagctattcaacaagtctctaggaagttccaaactttcccacatttttctttcttcttctgaaccctccaaactatttcaccctctccctgttactcagcttcaaagtcgcttccacattttcaggtatctttacagcagcacctcactctctgtggtaccaatatactgtattagtccattctcacactgctaataaagacatacctgagactgagtatttataaatgaaagaggtttaattaactcacagttcagcatggctggggaggccacaagaaacttaaaatcatggtgggaggggaagtaaacatgtccttcttcacatggcagcaggaaggagaagaacgagagcagtgcaaaaggggaagccccttaaaaaaaccctcagatctcatgagaacttaatatcataaaaatagcttggaagaaactgtccctgtgattcaatcacctcctactggctccctcccatgaacgtggggattatgagacctaaaattcaagatgagatttgggtggggacaaagccaaatcatatcagtggctatggttgaaggggagggcaatttaggatgatgtcatttctcattagtataactcttaaattatcaagcagaaataaatgttaattttgtctttcatatctagggaattttttttaattaaatacattcttctagtaaggtcaggctgacaagtaacaatttatctttggctcatgaatcatttaaagataatccacttcctaaatgctaaacacaatcagtatgctagttactcttctaaaaaatcaaaatgcacagattaagagcttgctctttttctctttctcaaaactaggatacaaaaataaaaataatcaccaatcttttgtaataacttggaaactgctgattagtgttttcaaatatttcagggagggagcgaagaagagagagagagcgagagagagagagcgcatttttttgtttggggggtgtgtgtgtgtgtgtgtgtgtgtgtgtgtgtgtgtgtgtagatcagtggttctcaaacagggattgtgatttttgccctctccatcctccccatcaagaaacatttcacaacaactggaacgattttggctcctcccaagtgagggaaggggtagaatccagagttgcagctaaacatcctacaatacaaaggacagcaccttacaacaaataattatctagccccagtatcaatagtgctgagctagatgattgacagatagatagatcgatagattgatagacagatgatagatagacagatagatgacagacagatagactttttttttctaataaagacatttaaagggtgcccattgaagggaagacttcatgttactcgaaacatgttaccttctttgttttgagaacagtcactcaattgcctcattccattaggcaaataagtgtggggcatctgtgcagtgctgaaagggatacagacaagccaagggcctatccctcttggaatatggataagcatgtatgttctactttgtagcaagaaataagggcaatggtggacaagggttgttaggtcatattgctattctaaatctgctgaggaccttcgtactttaaaaccttatggtacttggtcaattggaatggctgggatgcctcagggaggaaacatggaactttctgttgtgaagcctcaataggttgagtataaaaatattttcttagtgttatctttgaatcctgttttgctttttttattagaagagtctcagaagtaatcttcacatgattattattatcacattagtgtaatagaacctattaatacatttggtcttaattgttcttagaacgatggagtgagaggttaattattatgagcataatgtctatgttaatcttgtgctaccacttggtttaatattcctgtcaccttacaagtgtatctgagagtattcattactttcatttgtagtgtagatttttccttcagaataataatgtgcataataaatagttcattttatatagataacattttataactgtcttttaaaatgtaatacatgtctattaggactataggcatataaaatactttcttttttattttttggtttttcttttagataattttgttttgaaaatgttgaatgcctgttttgtaaatatttaattcatttattcattcattcaatcaatcactcagtaaggatttactgatttttctgcaaagcattttgttagatcttgagaatataaaaaagaataagtgaagttttcactctcaaagtactcagattttaattttagagtattttctcttcatggattaacaattattgatatgaaaacttattggaaaggaagtcaattcaattgtataaccactttcatttcaagtaagatgtcacatgctatacagattaatttgaaaccatcaaacctagaccattaagcaatttaatttcctagttgtaaaatcaatgtccatttcaaattcagccagctaaacattttaactataagtttagtatattcaaattgaaatatacacaatgtttctaattagttctaattactgacagacatgtagtaggtagtgtttcctaacattatagaatcgtcatgcctcttgaggtgatacaataccaacagaggaatcgctttcctttcacaggtatgttaagaaaccaaattcttggccaaagcaggcggatcacaaggtcaagagttccagaccagcctagctaacatggtgaaaccctgactctattaagaatacaaaaattagccaggcgtggtggcgtgtgcctgtaatcccagctactcaggaggcagaggcaggagaattgcttgaactcggaaggcagaggttgcagtgagccgagatcatgccactgcactccagcctggacgacagagcaagactccatcatgggggaaaaaaaaattctttagagttgccaatgagatcaccaatggcaagctttatataattctgaatgggtcacgttacttaagttgcttgtatataaacttaatatgaacacaatcacttttgattattttaaatgctaacatttcttggaagaaaatgtttattttagcacttaacctttcattttgcattcccttttaaatgctatcctaaaattttcaaccatttgaataaaattaagtttccattttagtgagaaagttcttcaataattaacataacatattcttcaactataaaatattatgatataaagtttgactcaaaagttgagttaatgattttatctatttaaaataaccacagtagtgataactcagctaaatcaacccccgttttcatatttttgacagtttacgacctacataaaatatgcacacagatataaaacatccagtaaacttcataggcatctgtttaaaaacagaaaatattttaagatatttgagaaagaaggaggactcatttaaaacactgatattttattatcaatattttatttaatacctatgatgtaccagatttttacccaggttattgtgagcatgcaaataatttcatgcaactctggagaaaaaaatatttgtgactaagtctaagcagttagacagcctagcgaccctactgaaacagaacttctgatttttatggctgcaccaaactgcatctgctttatttcactgcaaaccctgcgtgtttttaagacaacagatgtggctcactctaagattgcatttcttcccgtgctaattttctctcctctccaacacctgcccaccgttgaatctcaaatcaagtttcatccctgcctttcattcattatttaacatttatttattaatcaacaagttatgccccagttacacgctaggtgccaggtgtgtattcaaccgggaagaagacagagaaatccctgaacacatgaagcttacagtctggttaggaatatagaaaatcaatgagtaaaacaagtaaatataaaatgaaagtaggtgctataacagataacttgagaggaaaaattttagacagaacagttaaggaggatttacctctagagatgacttttaacctaaaatttgaagaaggaggaagaggccacacggaaccaatgtgggaacagaagagaaaaatactgaaaacgacacattattccagttggaagaagcagtgagattaagggctctggggtaaaaagcatttcagagagtcctagaagtaatggaatgtcaaagtgaatgcagcgtgtgagagggaggaagtcaggtattgggtgaggtcgaggaacacaggcaggaacacaaccatgcagggtcttgttggcaatgacaagaagtctggattttattttcagagtacaagtaagccaatgaagaaccttcaaacagggaagtgatttgatgtaatatgtttttttaaaaaacaccctggccatagtggctacaatgttgagaagcaggcaagagagaactgccagagcccaaataaaaaaatgatggaagcagccaggtgtggtggctcacgcctgtaatcccagcactttgggaggccgaggcgggaggatcacccaaggtcaagagtttgagaccagactggcccacatggcaaaaccctgtctctactaaaaatccaaaattagccgggtgtggtggtgtctgcctgtaatcccagctacttgagaggctcaggcaggagaatcgcttgaacctgggagtcggaagttgcagtcagctgagatcacgccattgcactccagcctgggcaacaagagtaaaactccatcccaggaaaaaaaaaaaaaaaaaaaaaaggaagctttgaccagaatggtttcagaggtgacagagaaaaaataagtagatgtaagacgaaatgttgaaaaggactttctgaaaaggcttgaatataaagagcaaactgatgagtaaaaaatgactttcattatataggtagacaatagtgttatttgctgagacaggaaaggccatggagggatgtgtgaatggggaaggaaggaaggaatggaaagtagagaagcgatgttaggagtaggagaccaggaattgtattttggatatgttaaatttaagatacagatgaggcatacaagagaaaatattaggtaggtgtttagatagatgagtctagaattcataagaaagttctatgctggaacaggcataaaaagagaaaaaataattggtcaccgagataggagaaacaccaacaacttactctttttgaagcagacatagaaaattacttcaagaagatagagtgtattcactaaaatgcttagtacaatggagacagaaaattggctttgtcaacatgaaggtcgtatagagtgaccattgtctcacactgcttagaataatttctgtttgtacatgttgtcccagagtcataactaacaacactcttttttatttttaaatatttatcagtttgaatgacaaaattctctactcacaggtgacagtaacaaaagctgtgtcagttgtgggaacatggataccagattggataggactgaatagtaaagaacaagtaacaaaatcaaaatctcatgtgtggcaaacttttgacatgttgactttgaagaggaacagaatcaaagtaatataagatctcgagaggtgctgtgttgcagctgagaaattttaaagcctttttttttcttttttttggaaatggttcagcagagagaaaaagatggataatacaagaaaataaaggtgatcctgaagaagagaagtccttgaaaatgtgaaaaaggatggagtctagcggttggcagaggggttggctttggatagaattggatcaagtcctcccagtagcaagagggataaactatttctcttaaaccctgtccttcagatatgtgaccattctgttctaaacttctataagcaacttatcatgccatgattagccacagttttcaaatggaagtctccagctatgctgaactctgactttttaagaattattctgtttctggtaattacagaatcactatttctagttattttttagtcaattatatatgagaaccattttgcataatattattgcattgtttcaaatgatatgaaaatcttgcaaagctttttctaaaaaaaaactagatcattgtttctcagctttttggctatcaagtgaaaaataactagatcaatttttcttttagcttaaatttgggcaaatttcattagcactgtgttttattgcagttagcatgataattagtcattaatggttagttcccttaaaaaataaatacatctgacaggattatctaggaatttacatttcagtggttcctagaagtattctgctagagaatctgtggatatggacttaatgtattcatttttattgacatgcagtgatcaatgaggctttaacaattaaagcaacatgcaaggtcataacagagagtacaccaaagcagcaggtaaccaacaactatagagaatgtcaacttggggagagactgatgtatataagctaaatgatatacagactgcattattccatgtaggctctagtcaattaactgtgaagacccttttggaagtgttccatacttcctaattagaatgctttgaaacttaactttcctattgttgtattgatttaacttgaagcttgctaccttcaatatgctctcattatatattaaaaaaggccatataacaaaaagatatttgactatcctttttgagaagatttgatgtaaacaaaaatatattaggtattgtaaccctgataatatacaactgaaggaagcaaatataggcttgacttttgattctgaagtcatctaaatgaacatagaatgagaaagcacatgaaagcaaccattatgtatacttcagaattccttttcacaaaataacttttcattaatagaaaaaacttaagaagtaacacaatgaagtaggatatgttcttttcaaactgaaaggaatttgatagtatttgtaaaatgacttgaattaagcattaattttctgaaataatgattattctaaatgtttctcaaaagtgagtttacctcccataacacaactgactttcaacatttgaattttctgacatctattgattcagtaaactaattacactatggtgatctacaagaaacattttaaagacttaaattcaaagtattatgtatctagcatttcaaaatgcactcaactggatcataatacaagttaatgagaattaaaatttatcactcaacaattgccttcaatattgcaagtttctcttaataagataaccataatctttatttttatatttacactgaaatatctcacaggaaggctttctgaaactgtggttaatataaccttgttttattttttagcaagaatattttttcatctctgttttcttatatgaaatactaaaattataaactatccactttcagtttgttttcaaactgtttgtattagcataggagacagttgacctcttggcaaagataagagaaaaatgaggcaagctagaattacagctgagtcaagtgaatcatatgcagcagaaagatttaagtagaaattttaactgtaggtcatttatactagaacctctcttatcaggttagagtaaaaaacatcatcaaaaacaagacatatttcaggtaaaattgaaggacacgagtaatcagtggatacctgttgaagcctatactatgatatgctaatctttgtttccataagttgttgagcctctaaagggcatacatttgtatggctcagtaaatgtcactaaattgccattatccaattcttactaaaagcatgcatttggcagaaataagccaattatactttatgatattgtctatttctagcctatattattatcttgttttaaaaagtgctttcaaaatatattttgaaattatttttgctgaaagaataagactcaggcctttgacttgtgtatactttgaatttttatatcccagatatatgataaaatgcctgggtacaatagcttcccagtaattccacataaatgcagctgctatgtgcttcttttggtaacatctgccctttttgatcaaaatccaaccaaaaatattctcaaaactcttgaggtccagacgacttatagactgacatcagctacataatttcagctgaacttccacagaataataaaaaatatctttttctagagaaaaaaaccccaaaactctgatgttaaatggacgtatcaagtaaaaccaaaattactctatgctcctctgatttgactaacagtattaataatagcagtatattttgttagattaatttcagtaattttataataggtaatatgttttcaagtaaaatgatgggaaatgtcctactttttaaattattttgtgtttaaaaatagcccctaaaaggtgattggtaaccaatttatcagagcactggaataaattgaattaaaaattacaggccaggtgcagtggctcaggcctgtaatcccagaactttgggaagccaaggcaggtggatcagttgaggtcaggagttcgagaccaggctggccaacatggtgaaactctgtctctactaaaaatacaaaaattagctgggcatggtggcaggcacctgtaatcccagctactcgggaggctgaggaaggagaatcgcttaaatcacagaggtggaggttgcagtgagccaaggtagcaccactgcactccagcctgggtgatggagcaggattctttcttgagaccctgtctcaaagaaaaacttaaacatggttaatttctattctaattaactggcctatataggttacattttaagatcctcttttcccacgttaaatgatgaaatttcactcctactctatcttttgtgttaaaggaatatataccacttggaaaggaagagaaaaataggtttatgatacaggaacaattccttggatgaataattatcatttaaaatgaaaatcaattgttcattttttattttgttcaagttaaagtaaaatcagtattccatggtcatgtttttcttgacactgctgacaggggttaattaaaagattaatgggataatgtacacatttcattagaaacaaattttttattttttggaaagtagttaaatagctaatttttgtttgtttggttccacttcactgattttccagcactctgagccaaagtattcccgctctaattgacacatgtcctgttcttggtttcattcttaatgtcttccaaatgaagtgcaaaacttggatgcttactctagtgataatgtttccattgtctttgttccaattgttactaaaatttgtggtttctttcagactgctctgtgttttgaatgcacaatttgctgcatttttataatattttctaccactcaaacacataagaaggtatatgatgtgatgatgaaacaatttttcattcctaggcattatgcgccagtacgccgggtgaatcctggagtagtttaatggaaagtagaaagaagcaattatttaaaacatgtaatctgacatgctaagcattttgatgaagttataattatttaacagataaatagcgtatatatcagtacatattttgtaagcaatgcaataaaccactaaaaaccaagattaaaagaaatatgagcactttggttcaaattcaactactaagtgttataaattgtgtttactgattttttgcttttatcctaaaggtagacagttatattttcccttatagaaataattctcatcttgtttattccactttgttttagctgatgtactcttcctcgtgggtgcaaagctagaaaaccttttccagcttcccttgtcatgaagtgtctccatgtgactaatctctagccaacagaatgcagaaaggggtgggatttgccacttctagtcctgccccattaaacctttcaccagtccttcaccatgctgactggtggagaattcattttctcagcagaatatacatggaacacttcaacaatataatttgagtaaggttaaataaatgaacttttcacaaagatgtggtcagagagtagaaaagccacaaaggattgtacagaatgccaggaccacaacatagttactctgacactatctctacatctaaagactagaggaagagaggagttatcagaacagagtagagggccatttgccaggagcaaagaccttgactttagggagagaaccaacccatgggacacaacacaaggtcaaaggaatacacattcaggctttaccctcctgcctccctatttttttgatatgaagaaagaatctgttctagacctttctctttggcttgaaggtggctgtcttctgtcttcatggtgtctatcttctgtatgggtctctctctatgcccaaattttctctttttataaaaacaccaattatattttgttaaggcccaccctgatgaatttattttaatgtgattacctctgtaatgactctgtagctaaataagcacacattctgagctgctgagggttaacacttcaatgcataaattttgtgaaaacccaatttaatccataaaagagcccactaatttaatccacacaggtaaatctcagaggaccagcgcagaaagaaaagggaaacgagctgtagagcggatctggagaagcccagacattgagagtctattgggtactgtaggttagcctaccctattaaggacagtgagtactcctttgattatttatctgatctcttacttaaatatcctccagtaagactctattgcatacgatgtagttcacagttcttactgtggcatttgatgacctatacaacctgactaccactgcattttcatacccaattctcattccttcctacctaaataatctcaaattattaccttcctctcttcttttgataccagtacttaattaaggaacacccttctcctattatcatctaacaaattaatataatgacattcaggctttgtatctggttctgcatcacttgagaaaatatctgccagtgtgtggatttcattggtacatgtcagtcttctaaagtgtcatgtcatttactgtttatataaatcatatgccctttttcaaaatgctttgtaatttattgcatgtctaatgcaatgatttattgtatccaatgcatgtggatgactgtacataaacatagctggtaaattattatctcaaggataattaaagatgttctcatttgttctaggttatttggctttgcagagtttgtagaataggaaccacctgctgccaaagggccaaaccaataaattctccaggagacagttttagaactgacagagtgtttgtgaattacttacaaattaagatattgactcaaattaggatattgttgtcttaaatctaagacaagaaataaagtaattttttaaaattaatggcagtatttttaattggtagatacttagaaaaatctaaaatcccatagattaggaggtcagaaaagcctaacttaactctcttttaatcccaaattctacccttcttcaaggacaaggtagaatttaagcggtgactttaaatggaaaaaggcccataatacacttgttattaaaggcaaactcaattattatgttaatataattatgttttagtatataattataatgtaatatatattatagtgtaatatatgcaatgattataagtagtatatagtatattaaaaacttaatacaatacacatgcataattataactataccaacagacatgaataaaatataacatcagactctcatatttgtgctttacagaaaatacatgtgccactatcttcagcttctcagcagcaccttctaccttaatgttctacctggtggtgttcaatagtggagtgacaaatgctcacccatttgcattttgcttcatgacatactctatgctatttttctgccttctaactttactgctttgtcccattttgactgtccctttcattaaaatatgagcaccagctatagttaatttctcactaaaataatttttagtatgtgtgcttttagtatctttattatgccaaactgtatttcacctgattttaagcactccatattttccttcctgcttttgttattttaagcaatcacacatttctttttcaaaaggaccatcctgctctgcagaacagcttgtctttccttgttctcaaaaataatgagccaggttactttttcacagagcatatttgtttcgctttttctgagatagatcatcatgggcctagcacaattttgctgtcctttttcttcccagttctataagggtacgtaaggcaagacctttctcctatattcatattcaagaagaaagccatatttcaacaataacaaaataaaagagggtaaaactgggggtgaattgtgtgcacaccatttacttttattagaagaatatgtaaatggtcaaaaaattttagctgcaacattcatgaattgtgttcaactcataattcgtgtttttgactttttttccccaggactatattttaaagatactgaaaaataaaattaatggagcttcacttttgtactttatagatgataatcatggacaaaatatatttctataaattttttattacttcaaacaaaccaaaaacctgagaagaaatatttctgagtttagattatttagatcagatatagacagggtatcaactaatttttgataaaaataagaagcaatggtgtatgtaaattgaaacaaaattatagtcatataacttaaaagaaagtgattttttggttaagtattcttaaaagtgacattttgtaataaagatagtgaaaaatatgtattcttgggatttaaaaaatcttaaacatctaatgtttcttttaaagaagactagtgttttgttactttaaaaatacagactgtccatgtttagtaaaaacaatgatcaggtcaaggggcaggagatctgggttctaatcttgctcccttactgactagcaatgtgatagagaaagttgtccagcttctatgagtctcagctttcaaatatgcaaaatgactgctatgggttgaattgtgtttcactcaaaattcatatgttgatgccctagccatcagtacctgagaatgtgactatatttggaaatagggtcttcagagaagtaataagctaaaatgaggtcattatggtaggctttaatccaatgtgtctggtgatcttattacaagaggaaattaggagatagacacatacaaagggtagatgatatgaagacacagagagaatacagccatctacaagcaaaaggagacctcaaaagaaatcaaacctgttgtcattttgatctcagaattgtgagactaaattgcaattgtgagattaaattgcctgtagaatagtgagaaaattaatttctgttgtttgagccaccttgtctgccactttgttatggcagcccagcatcctagtaaaataggcattataagttttacgatgattagatgtagttatgtgtgtgtaaagcatatggtacatgttaattgtttagtgtgtgttaattaatattgttgtttcttctgctagtatttttactggacacatcatttataactcttatctttacctgatcttgaacatacagcagttctttcctggtgggggaaaacaggaattcaattcatattacatttctctagcatggttcatggggcctgtagcttcaaacttacagattttggagtgaaagcagccttgagattgtgtcattttctagttatgtcattatctgtacttaatctccctgtctctcagttttgcatctgaaaagtatagataattataattgtttataggaatacattcatatatgtaatacaattagtacttgatataaattcctgttgaagaaactataattatgattttttaaaaatgtatttttttactctttttcagccatgcctgaggccagaacagcttctgtgggttttccctctgtctcttcatgataccaatctgtcattctgctttattcaggagcccatctatgtccttcatgatttgattcttactgccacccaaggctcatgcacttgcttccctacagatgatggtcatccctgcccagggaaattattacctcgactgagatggcattttccaaagtgtactgcccccagcatttgttatttaggagattaaaatgatgagaaagatattaaatgtgtgtctgtgtcatggcacttttaagtatagtgacactaagcattaagaaaaaaaagaaaaaagatgatttattaaatagcatctcagagttcttaaaatgttcatgttcattttgagtattctgggtggggagtagatatgatgtaggctttcctcaatttatttgatgatacattattttttggtcaatcatttgtaagaatctgtattctagataatagaatttgggtagttctggcctaaggaagatagaacttccttaaaacctctcatttaacttttttcccagtctctgtttaggacttcttcttcttcctttttttttttttttcctttttattggctttaaacagatgtttccttttactaaataatctattgccagaaaataatttaatctacataccagcttatggctgtggtatgtgttttcagcatcactcaaagaaataaaaaaggtggagggaggtaaggcacataacaaaaaagcattacatctatattaaaaattaaaatttactaaaaatcaaatgagaaaaaggaaaagtttacttatcagattggcaaactgatttatttcagatgttcatgagcatttggggatagggtcaccttaaaacatagcttttgaaaatattaataatataccttaattactcaatctggattgtggtgggccattttaatttccttctttatgcttttctggaagtgccacattttctacactgaatataatttactttgttcatcaaaagaaattaccagtttagttgatttgttacaacagccatatgagaaaaatatgaggcttttatggatcttttgtaaatctccttatgtgagttcattgataatgtaatccctataatattcttttctcagtacattttttagaatatatagaaaagcttgacaaacattaattcatacacatgcacatgttaatactaatcagtataacctcaattttgaaatgacaagtacaatattgttagggatagcctttgctacttaatgagattaactggaaaagaaataattatcttacctgataagcagtgtatacttttgcccgttgtccactctaacagtagtattaatgcttttaaattttgcttcaccaggacagtaaaagtggtactgttgggggaaaaaattttgtcctcaaacagtttttcagcatgaaattaataccatatatttgcactggactttattatttatcaatatattttacatcactttggagagacatgaagtttgaaacttaaagagaagtgataactgaaggtttacaactgatatgtcctagatttaatacatacaaatatatgagtattatatagatataaatacacatgcatacatgtgtacacatacatgtctagattcttttccagtattctgaggaacatggttgagaaaagcaacatcctctactagcagaaagcaagtattttaggaattttccttacataacagcaattgagcaaggcaaagaatggttaatacaatctagagggcaatattaatgtcacaggaaggcaaacttcaagattgtgaaaactaaccattcattccaagttttttgagatgtcagggtgtctgggttcatttgtagaattactgttaatggcaactaagttatgatctagagaggaaaaatcatgtctatatcaggtatgattaaccaagtatccccaggaaatacatggatgtgctacattggcttattaagcttcttagcaagcatgtgcctacaggtatatggattatattgtgtctattctttcccagagaggggctttaatatttttattgtatctaaaagtgatctataacccacatgtgttaagaaactcacttgcattgtgtttcataacttgtgcccctagctgtatttaagttgatatacccaaatcctctcacatatagtccaaagataaagataatgctatatattttaactttttatgatatttgggccattgcaaaagactcctttcctttataagattatttattgtcagttgactttaaaaactccaataagaagcattaggaggaattattggagacttgtaggattgtaggtgaaaatattttatgaaataatgtattattaagactaatggatagccactactttccctatcaaatgggaaaaaaattaattcacaataggttaaacgaagatatttaggaaccataaaactaactagtgaatagaggtatagaatttctttccctttggttttatgaaaaagaaaggatatatacttacaagtctacaataattactattatttacttaattgtaataatttgtcaatctccatcttaagaaaatttaagatcatttacatttcagctagatgatcagagttcaaaactcagctctgttacttggaagttttgagacttcacatgtgctttgtgctaaaatctactcacttgtaaaatggggtaatacaaatttttgtgtgatttaaattggtaaatgaatgaatattgtgaagtaaatattataaatgggcaaataagtcaatcaaagtggaacacacagaattatacctgggacataattatatatgaaggctatgaaggctagcttttttttccttttttttttggctctatctcccaggcaggagtgccatggtgctatatatatatacatattatattacttcagaaacatgagcatttaaagaaagtcaaactaagggaatttgcctatttaaataataaggtataactcatcctttcatggaaattcacaacatgtacacttaaatcacatcataaaagaaatggtagcccaaatgctgttattatgtttcatatattagaattatataagttaattaccttattgtgctgagttattgcaatgatgattgggatgagttccctaaaccaggtattcagagcagggatatgagaaaatttgttaaggtagaatgatgttgggaaaagagcatgcactttcaaatgaagttggtttcaaaatgttattagctgcataaccttggacttttgaaaggttcttataacacttaccaagtgcaaagtcagcaatctcaaactttttgatctcacagtctctttgcattcttaacgtttattgagaaccccaaggagtttttgttaactcagttgtgtctatcaatatttacattgctaaaaattacaacacacatttttaaaatacaaaaatacataataaaatgatacattagcgattagagcaaggatataattgcatgtcatgtagcctctggaaaactctactatacacttatgagagtaaaagtgaataaggcaaataacaccccttgcctacagaaaacttacaaaaacaggttttctcttgaggatcctctaaaaatatcttgggattccctagggtttcccagactctacctgcccttaaggttataaaaatggtaacaattattatcattgagaaattaagaaattgggaaactggtcaataaagaagtagaagaaaagttgaaaataaggagaaaaaaagacaatgaatgttaattcaaatcatgtaccgtttgaaatattaatatctaaatatatataaactgatctatcagtatgaatgtaaatttttctccgtatagtatatgagcttcttaagaacactctcttgtcttctgaatgatattctaattaggtatattttccagaaaaaatagagaccttttgagcaaaatactctgacaattatattttttaaatttataaatatgtgattaatgaaatccagttagcttattttttgaataagttgttaaccactttatattattattaaatcagtttttttgcttaaaaatacttggttgttgttggttcatatatacatagaaagaaattataaaagtagaggaagagacatcctggtggtgagtataatatatagagttaagtttaaattttattttgaaaataaccaatgaagcacataattagaacaactttgtaatttttaaaaaattaaatgaactgaataacttacctttaaagtaccattttcaataaacaattgaataaaaaatccatctactaaatttgagtcttgcttgacatacagcagaagtccataggagctgaaggtctgaaattctagggagatgttattttgtggatttaaagccacattctgaaattctagataagaatctccataataacgaacacaactgaaatctgtggagtcagaaagaaaatacaatttaggttgaaataaatattcaatacctaggtttcacattattaacatagcatatgttttctctaatgactcatacgtctctttcctgcctctttcaagcccaggcacttctttcctttggaatagtcatggcagttttctcatgatttctttgtatttgatggcttcatgataaaatctcattgtaaggcaaggaaatcaagatgattactcttcaacactgcttttacttagattttatgttacaggttaacagaaaagggcacattttctaaatatgtacttatttcttctttatataagatattgatacaaattatgattaatattgttaataatttaatttgggaggtttgtgagggaatgctagagattattgagaggcatagaaattgttaaccttttgtattaacactctaaattatatgagtttcttaacaactctcaccttctgaatgatattctaattagctgtagattttcagaaaaaaatgaagacactttgagcaaaatactccacagttaaatttcttaaatttgtaaatatgtgattaataaaaccaagttagcttatttttgaataagttgttaactactttatattattattaaatcatttttttttgcttgataaatactggattgattgttcttggctaatgattcctgaaacaatggatttgaatatcgcctttcttccagttcctttcttcttttgttattttcatgacgtccccaacacaagctttctttctcttttaaaactttcgaattatgtattatttataactactagaaaatattatttataaaaccatgtgagttttagtttgctgtctatcacaggataatattcattttcgaatctgtactttaaaacttcaagaaattttatatcctatgtgtgctgtctttatttggaatttttaatgatgctttagaattactcattttgctacattttcaaacttgcaacaatttctaaataaataaccagcaagcctcaaattaatttttttcactggaaataaggttcaaaatagtgccaggaagcatttgcactttatagacataaaagcatgagtatatgtgtgtgtgtttgtgtgtgtgtttaatcaaggactgacttcattagtgaaggacaagttaatgactgaaaaaataacaatgtcctttcaattttgacattctaattttttcagttgttaaatgatagggacgtattttttttccccatgtagcgtttcaatggtgatgttaaaagcataatacaataacattttaaacaacaagaaattgttttaaagatttcaggcatttattttaacaaattgagaataaagtcatgtatcagtttgatttaaaattcaaattgtgaaagagcataaaatgttttcaaaaacaaacattacaagaagaatatacccaatattgatgaaattaaaaaaaattacatacagggggtcttcaaaaagttcacataaaatatgtattatttaaaaactatggatgaatttcactcatcatgacatgtctgaacagaatatatttgagttactaagaaggataagacatctgtttgaaaacagcccctatcggaacatgaattctgctaaaattgaagcaagaacaaatatcaaatttacgatgacgcttgggtgaaagaatggtaaaatcattgatgctttacaaagaaattatgtggacaatgccccaaagaaattcacagtttacaagtgaaaaacttgttttaagaagggacaagactacgttgaagatgaagtccttagtgactgaccatccatatcaattttcaagggaaaaattaatcatattcatgtcctaactgaagaggaccaataattaacaataaaaacaatagccaacactattgacatctcagctggttcaggttacacaactctgaatgaaaaattaaagttgagcaaactttccactcaggggatgtcaaaactgttgtgcccagatcagctgtagacaagaacagagctttcaattgcaattttaaacaaacaagaacaagatcttgaagtatatctttgaagagttgtaacaggagatgatacatggctccactagtatgatattgaacacaaagcacaatcaaaggaatggctatcaagaggtggaagtggtctagtcggagcaaaagtggaccagttaagatcaaacatcattgatatcgtttggctctgtgtccccacccaaatctcattttgtagctcccacaattcccatgtgttgtgggagggacccagtgggatatgactgaatgtttttcctgtgctgttcttgcaatagtgaatgggtctcatgagatctgatgattttaaaaacaagagttgccctgcacaagctatctctgcctgctgccatccatgtaagaggtgacttgctcctccttgccttccaccatgattatgaggcctctccagccatgtggaactgtaagtccaataaacctctttcttttgtaaatcacccagtctcaggtatgtttttatcagcagcatgaaaacagattaatgcagtaaattggtaccagtagagtgggcactgctgaaaagatacctgaaaatgtggaattgactttggaactgggcaacaggcagaggttggaacagtttggagggctcagaagaagacaggaaaatgtgggaaagtttggaattccctagagacttgttgaatggctttgaccaaaatgctgataatgatatggacaatgaaatccaggctaaggtggtctaagacagagattaggaacttgttgggaaatggagcaaaggtgacccttgttatgttttagaaaagagactggaggtattttgcccctgccccagagaattgtagaactttgcacttgaggaacatgatttaggatatctggcagaaaaaatttctaagcagcaaaacattcaagaggtgacttgggtgctgttaaaggcattcagttttataagtgaagcagagcataaaagttcagaaaatttgcaccctgacaatgcgatagaaaagaaaatcccattttctgaggagaaattaaagcctgctgctgatatttgcataagtaatgagaagccaaatgttaatcccccaagataatggggaaaatatctccaaggcatgtcagaggtcttcatggcagcccctctcattacaggcctggaggcctagaaggaaaatgtgattttgtgggccaggctaagggtatttccgctgtgtgcagtctagggatttgatgtcctatgttccagctgttccagccatgactaaaaggggccaaggtacagcttgagccattgcttcagagggtggaagccccaagccttggaagcttccatgtggtgttgagcctgcaggtgcacagaagtcaagaattgagatttgggaacctctgcctagatttcagaagatatatggaaacatctggatgcccaggcaggagtttgctataggggcaatgtcctcatggagaacttctgccacggcagtgcagaagggaaatgttgggtgggagccctgacacagagtccctactggggcactgcctagtggagttgtgagaagaggaccaccattctccagaactcagaatggtagatccactgacggcttgcactgtgcacctggaaaagccacagacactcaacgccagcccacgaaggcagccaggagagaagctgtaccctgcaaagccacagttgtggaggtgcccaagacaatgggaacccacttcttgcatcagtgtgacttggatgtaagacatggagtcaaaggagatcattttggagctttaaaatttgactgccctgctggattttggacttgcatgggacctgtagctacttggttttggccaagttttcccatttggaatggatgtctttacccaatgcctgtagcccctattgtatctaggaagcaattaacttgcttttgcttttacaggctcatagtggggagggacttgccttgtctcagatgagtctttggactgtggacttttgagttaatgctcaaatgagttgagactttggggaactattgggaaggcacaattggttttgaaatgtgaagatatgagttttgggaagggccaggtgtgaaatgataagatttggctctgtgtcctcacccaaatctcatcttgtagcccataattctcacatgttgtaggaggaacctggtgagagatgattgaatcatggggacaggtctttcctgtgctgttcttgtgattatgaatggttcttccaagatctgatagttttaaaaacaagagtttctctctttgcctgctgccatctctctttttctcagcacaatctctctctttgcctgctgccatctatgtaatatgtgacttgctccttgtctttggccatgattgtgaggcctccccagccatgtggaactgtaagtccaataaaactctttcttttgtaaactgcccagtctcagttatgacctcatcagcagcatgaaaatggactaatagagtcattaaaaaagatttctgggggatgctcaagacatttttctttttgactttctggagggccaaagaaggataacatgtccctattattacagtgttttaagaaagttagtcaaagctttagcagaaacatgcccatgaaagcttcaccagagagtactattccaccatgacaatgctcctgcttattcctctcatgaaattaggggtaatttctgagattatcaatagaaaatcattaggcatccaccttatagttctgatttgcctctttctgacttctttttgttttctaatctttatttttcttcagttaataatgtaaaaaggctgcattgacatgggtaaggtcccaggacactcatttccttagagatggactaaatggttggtatcattgcttgtaaaagtgtgttgaccttgatgaggtttatgttgagaaataaagctaatttttaaaatttttatctaataccatttttcacaacatttcgaagtcttttcatattattttatagcttttagaaagaaatatactgcctgacaataaaaaactcaaaaactccttaatattattaagatatgtattttatagactaaattttaaaaaattcagtggctttttcattatgtgactaattatctgtatggaaacccatatatgcattcaattgtaaagtacttgagagtatgctggatttatcattctattccaagaacctagcatgatacatgattctgtcaagcatctgaaagcacatactatagcttggatgtttgtcccctccaaatcccatgtggaaatgtaatccccaatgttgaagttggagccaagtggaaggtgtttggatcactagggctgatcattcatgaatggcttggtgccatcttcacagtaatgagtgagttctcactctgagttcacatgatatatggctgtttaaaagagtgtggtacttcctttctctctcgtttcctctcttgccatgtgaaaccctgcctcccacttcacctccaccatgatttctgagggcctcaccagaagctgaggagatgttggtgctatgctggtacagcctgctgaaccatgaaccaattaaacctctttcttttataaattacccagcctcaggtatctcttgatagcaatacaaaacagactaacacactatctaatagaaaatataattgcttttgtttaaatgtgcttggaaaattatagttaaatatagattttaaaaagtcaggacgatattttgcacacagttttcaatcatatttgtggtgttttctatttaaatatataagtacagattttattttatgcttccctcagcaaaaattttaaacagatgagaataatgattatagcaagcacagaatagctttgtgaagaaaacataaatactgagattattttcagtaataatgggctaaagtaaaataataattctatacatttttattgtctagaattaaataataaacttctgcacttaagtttttaccttcctaaatagaagaaactttatctgaattgtatggattcatattatgattatacctataattttgtatgcttttggtacaaataaccagaaattctaattccaaatagtttcagcaataaagaaatgaaataggttaaataaaaggaagttcaagaatagggtgggttttcagatggatgtatgtttatggaaaagcttaactgacttctcataaaatacctagattactcctgtctctccactctgatattcacaggctgagttttaatatgagacttgcttttcacatgattccaatgtgatggctagtcactccgtttccaaaactgttcttctgtaataggaggaagaaataactttctcaagttaaggagaacctttcctagaagttaactggctagaactgggtgaccaatgaagccctctgttggagatgaggacgggctcagctcccactgagagctatggaccagggttcataatgggcaaaactggtattctgttaggaggaaaacctcaacatctaattccagtatttctccacattcatgaattatttcctgaattatatctgattgtcagattaaagacttaagatacacaatcacatgtccaagctaaagatattaactttcatcttcaacttcctccctgtttctctttatatgcagtagctcttgcctttatttctagaaactcatatggagtttaaggatgagtctagccatttaaaaatttacttgaaacatggttgttgctaggtgggtggttgctagttgccagcttttatttttcacatgtaattatttaagttttcagtacatactaatagccactccccttgcatgagaataacgaaaacttaaaagctgtgtaagagaaaaatcaggaatcaatgaaccttccctctctactgcaacagagtttttttaatagactagaaatataatagaatacatgtattttagaagaaatgaataatagaaactctgaagtatatgtgtgtatatatagaaaatacaccaaatgagtataatatttctctcagattaattatgaatatttactccaacaccacatattacttttaataaaacaaatatatatttttgaaagtgtaaaggaatcttagcttggggcatttttcatttttttttgttttgttttggttagcagatcataaaattctatatcaatttttaaaaatcaagtattttttatagttagtgtttctatatacaagattaaatgtgaaagttggaatattatgagagaataattgaatactaggattttctataaaattgatagtttgataattactctgtagtgatcaggtagcttaagtaaagatatatataatttggtcccatatctggtagttattaccaatatagtataatccatgaataactgcccaaagaaataattatgtattgctctccacagtatatatcattagataaatgttaggaaatattttgcaaccaaaatgtaaaatgatccctttctccaggtttcttgaaagcaatatctaagaaacaataatggaaatgtataatgtatgtgtgtgtgtggggggggggtgctcatgtacatttgcaactttttctgttaagtgaagtattaatttgagaaaaaattttatgtatgacacttaaatataattaatattgaaagatttactatgctgtttattaagaaacctgtatcacatcttgattcttgattttaacagtaagcagatcagcaactgtgtattacccacagatactgtctaaaacttgtgtctctttgtgttatttctctaaagaagagcttgaattttatcattacaaaatctctgcatatttaatactttaaatttctgtgttctacaaattgtgtctaattcaccttaaaatccaactttacataatccattttagctcatcccaattagcttaatacccactaatagagcaggataaagtaggaaaattagcatttatttacttagtatatgataggttttattagaagctttacatatgcttcttgaaattctgattttttttttcctggcaatgtaaagatttatattatatgaaaatgtttcaaaataagttatgaaatatatttgtttctttaataggttcccacaaattcattagtaccttgatcaaaagtcactaatttatataaagcatattttaaagcaagtattaatcataaaatgccaaaaaaagtttacaaaacaatcaataatactgaaattaaaagctagactacagagtttaagatttgcagagactcctcaatgtggctaaaggaaatatataagtagtggcagattatatgaaaatagattattgcaagggaatgtccaggaggactagtcaagtagttgaataactttttttactgaaagcaatcaatgatctttttgaagggaagcaaaacatctataatcataatatttctcttcaccatgaaatggagattgattagggaaaaaattatttaatagcaatccgtaaggatagaaagtaactttctaaaataaaaatcaaatcatgccacttccctgattaaaaacataagtgccggacagtgggtgcaggacagtgggtgcagtgcaccgtgcgtgagcctaagcagggcgaggcattacctcatctgggaagcgcagggggtcagggaattccctttcctagtcaaagaaaggggtgacagatggcacctggaaaatcgggtaactcccaccctaatactgtgcttttccaatgggcttatcaaacggcacaccaggagattatatcccgcaggtggctctgaaggtcctatgcccacggagccttgctgattgctagcacagcagtctgagatcaaactgcaaggtggcagtgagcctgggggaggggcgccagccattgcttgggcttgagtaggtaaacaaagtggcctggaagctggaaatgggtggagcccaccacagctcaaggaggcctgcctgcctctgtaggctccacctctgggggcagggcacagacaaacaaaagacagcaataacctctgcagacttaaatgtccctgtccgatagctttgaagagagtagtggttctcccagtatgcagcttgagatctgagaaccagcagactgcctcctcaagtgggtccctgacccccaagtagcctaactgggaggcaccccccagtaggggcggactgacatctcacacagccgggtactcctctgagacaaaacttccagaggaacgatcaggcagcagcatttgcggttcaccaatatccgctgttctgcatcctccactgctgatactcaggcaaacagggtctggagtggacctccagtaaactccaacagacctgcagctgagggtcctcactgttagaaggaaaactaacaaacagaaaggacatccacaccaaaaacccatctgtatgtcaccatcatcaaagaccagaggtagataaaaccacaaagatggggaaaaaacagagcagaaaaatgggaaactctaaaaatcagagagcatctcctcctccaaaggaacgcagctcctcaccagcaatggaacaaagctggacggagaatgactttgatgagttgagagaggaaggcttcagaagatcaaactactctgagctaaagaaggaagttcaaaccaatggcaaagaagataaaaactttaaaaaaaaattagacgaatggataactagaataaccaatgcagagaagtctttaaaggacttcatggagctgaaaaccatggcacgagaactacgtgatgaatgcacaagcctcagtaaccaatgcaatcaactggaagaaagggtatcagcgatggaagacgaaatgaatgaaatgaagtgtgaagaaaaggttagagaaaaaaaaatacaaagaaatgaacaaagcctccaagacatatgggactacgtgaaaagaccaactctacgtctcattggtgtacctgaaagtgacgaggagaatggaaccaagttggaaaacactctgcaggatattacccaggagaacttccccaatctagcaaggcaggccaacattcaaattcaggaaatacagagaatgccacaaagatactcctcgagaagagcaactccaagacacataattgtcagattcaccaaagttgaaatgaaggaaaaaatattaagggtaaccagagagaaaggttgggttacctacaaagggaagcccatcagactaacagctgatctctccacagaaactctacaagccagaagagagtgggggccaatactcaacattcttaaagaaaagaattttcaacccagaatttcatatccagccaaactaagcttcataagtgaaggagaaataaaatactttacagacaagcaaatgctgagggattttgtcaccaccagacctgccctaaaagagctcctgaaggaagcactaaacatggaaaggaacaaccggtaccagccactgcagaaacatgccaaattgtaaagaccgtcaaggctaggaagaaactgcaccaactaacgagcaaaataagcagctaacatcataatgacaggatcaaattcacacataacaatactaaccttaaatgtaaatgggataaatgctccaattaaaaggcacaacctggcaaattggataaagagtcaagacccatcagtgtgctgtattcaggaaacccatctcgcatgcagagacacacataggctcaaaataaagggatggaagaagatctaccaagcaaacagaagacaaaaaaaaggcaggggttgcaatcctagtctctgataaaacagactttaaaccaacaaagatcaaaagagacaaagaaggccattacataatggtaaagggatcaattcaacaagaagaactaactatcctaaatatatatgcacccaatacaggagcacccagattcgtaaagcaagtccttagttacctacaaagagacttagactcccacacaataataatgggagactttaacaccccactgtcaacattagacagatcaacgagacagaaagttgatgaggatatccaggaattgaactcagctctgcaccaagtagacctaatagacatttacagaactctccaccccaaatcaacagaatatacattctttcagcaccacaccacacctattccaaaattgaccacatacttggaagtaaagcacccctcagcaaatgtaaaagaacagaaatgataacaaactctctctcagaccacagtgcaatcaaactagaactcaggattaagaaactcactcaaaaccactcaactacatggaaactgaacaacctgctcctgaatgactactgggtacataatgaaatgaaggcagaaataaagatgttctttgaaagcaacgagaacaaagacacaacatatcagaatctcagggacacattcaaagcagtgtatagagggaaatttatagcactaaacgcccacaagagaaagcaggaaagatctaaaattgagaccctaacatcaaaattaaaagaactggagaagcaagagcaaacacattcaaaagctagcagaaggcaagaaataactaagatcgagcagaactgaaggaaatagagacacaaaaaacccttcaaaaaagcagtgaatccaggagctggtttttttgaaaagatcaacaaaattgatagactgctagcaagactaataaggaagaaaagagagaagaatcaaatagatgcaataaaaaaatgacaaaggggatatcaccactgatcccacagaaatacaaactaccatcagagaatactataaacacctctatgcaaataaactagaaaatctagaagaaatggataaattccatgacacacacactctcccaagactaaaccaggaagaagttgaatctctgaatagaccaataacaggctgtgaaattcaggcaataattaatagcttaccaaccaaaaaaagtgcaggaccagatggattcacagccgaattctaccagaggtacaaggaggagctggtaccattccttctgaaactattccaatcaatagaaaaagagggaatcctccctaactcattttatgaggccagcatcaacctgataccaaagcctggcaaagacacaacaaaaaaagagaattttagaccaatatccttgacgaacattgatgcaaaaatcctcaataaaatactggcaaaccgaatccagcaacacatcaaaaagcttatccaccatgatcaagcgggcttcatccccgggatgcaaggctggttcaacatacgaaaatcaataaacgtaatccagcatataaacagaaccaacgacaaaaaccacatgattatctcaatagatgcagaaaaggcttttgacaaaattgaacaaccttcatgctaaaaactctcaataaattaggtattgatgggacgtatctcaaaataataagagctatctatgacaaacccacagccaatatcatactgaatggacaaaaactggaagcattccctttgaaatgtggcacaagacagggatgccctctctcaccactcttattcaacatagtgttggaagttctggccagggcaatcaggcaggagaaggaaataaagggcattcaattaggaaaagaggaagtcaaattgtccctgtttgcagacaacatgattatatatctagaaaacccctcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaattaaataaaagaggacagaaacaaatggaagaacattccatgctcatgggtaggaagaatcaatatcgtgaaaatggctatactgccccaggtaatttacagattcaatgtcatctctatcaagctaccaatggctttcttcacagaattggaaaaaactactttcaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatacagaccaatggaacagaatagagccctcagaaataatgccgcatatctacaaccatctgatctttgacaaatctgacaaaaacaagcaatggggaaacgatcccctatttaataaatggtgctgggaaaactggctagccatatgtagaaagctgaaactggatcccttccttataccttatacaaaaattaattcaagatggattaaagacttaaatgttagacctgaaaccataaaaaccctataagaaaacctaggcaataccattcaggacataggcatgggcaaggacttcatgtctaaaacaccaaaagcaatggcaacaaaagccaaagttgacaaatgggatctaattaaactaaagagcttctgcacagcaaaagaaaccaccatcagagtgaacaggcaacctacagaatgggagaaaatttttgcaacctcatctgacaaagggctaatatccagaatctgcaatgaactccaacaaatttacaagaaaaaaacaaacaaccccatcaaaaagtggacgaaggatatgaacagacacttctcaagagaagacatttatgcagccaaaatacacatgaaaaaatgcttatcatcactggccatcagagaaatgcaaatcaaaaccacaatgagataccatctcacaccagttagaatggcgatcattaaaaagtcaggaaagaacaggtgctggagaggatgtggagaaataggaatgcttttacactgttggtgggactgtaaactagttcaaccattgtggaagtcagtgtggcgattcctcagggatctagaactggaaataccatttgaccctgccatcccattactgggtatctacccaaaggattataaatcatgctgctataaagacacatgcacatgtatgtttactgcggcactattcacaatagcaaagacttggaaccaacccaaatgtccaacaatgatagactggattaagaaaatgtgtcacatttacaccatgggatactatgcagccataaaaaatgatgagctcatgtcctttgtaggaacatggatgaagctggaaaccatcattctcagcacactatcacaaggagaaaaaaccaaacaccgcatgttctcactcgtaggtgggaattgaacaatgagaacacatggacacaggaaggggaacatcacacaccggggactgttgtggcgtggggggagtggggagggatagcattaggagatatacctaatgctaaatgacgagttaatgtgtgcagcacaccaacttggcacatatatacatatgtaacaaacccgcacgttgtgcacatgtaccctaaaacttaaagtataataataataaaaaaaaaatttgttaccagttggctatgacaaaactgtttagcattcactctgtatagaacccttccacccctacctttggccttgcaatgtagagtaccaattattctaggataacatacaaaacaatcatccttcctttgttcttctgtattttggctctgtcaggcagtgttcttccatgtacctgaatctgtttctgggctcattatcctattccatttgacagattgtcaaccctcagccaatcaaacacagagttaattggttttttgatgagattttgtatagcataggtcacgttctgcatattgttcttcttcttcagggttgtgttgttttatttttgccctgtgcccttttatataaatattgaaattagctacatatgcaagcatcctattaagttgcataaaaagtcattagaaattaatgtgaattccattgattttactgaaaatgtataagtacacttgacccttgaacaacatgagtttgatctgtgcaggtccacttaaatgctatttttttttcaataaatacattctgtactcccaattggtgggttctgtatctccaacaaaatgccaaccaaaaatacaacatgtatacttgtggtataataaatctatatgtagggttgtgtggggacacttttcatatgtgggggttctactggatttttgtagtgccaactgcattacttaagtatccacagattttggtattggtgtgtgtgggaattttggaaccaatgcccaccacaaagagatatgtagggataactctaatttatatccttgtgatattttatcttcttgtatgtggatacggtagatgtctcccttatatgacgacttctatgacatttttaatgtagtttcgtaatttatcttcataaagagcatgtgcttactttctcaagttaacgtatagaaatcttattaatttgttgccattttaaaatattttataacatatatttaactcattatattgatgtatagacatgcaattcatttacatattgagcaaccttgtcgaactcttctacttctatttatttatttgtgtgtgtgtggagacaggatctcgctatgttacccaggctgatgttgaactcttggactcaggcaatcctccctcctctgcctcacaaagtgttacgattataggcaggcatgagccaccacacccaaacacgtttatttttaataatactatatcatctgtgaataatgagacccttcttttgtttctaattcttaaaatagtttactagtttattccctgcctagaaccttcagaaacaacactgaactgaaataatgacaataagatttcttttcttgttttgatttttcatgtaagacttttaagctttcacatttgagtttaaagttttctgttcttttgttttattattattattttattttattttaagttctgggatctatgtgctgaacatgcaggtatgttacataggtagacatgtgccatggtggtttgctgcacctatcaacccatcatctaggttttaagccctgcatgcattaggtatttgtcctaatgcactccctccccatgtccccaatcctcccgacaagacctggtgtgtgatattcccttccctgtgtctatgtgttctcatttttcaaatcccacttatgagtgagaacatgtggtgtttggttttgtgttcctgtgttattttactgagaatgatggtttctagcttcatccatttccctgcaaaggacatgaagttttcagttttttataagtgataccctttaactcattaaaaaactttccttctattcttagtttgctagaaattttgacagaatttaacattaattacgtttgttcacttactgatatgattatactgtgaacaactttggtattttaatattaacccattattttaccccaggaatatatcaactgttctgatggtatgtacacatatgaatttcatttttaataatttatatttaggatatttgcatctatgttgatgattgacattgcctttgaattttcattgttcatgataccttttctgattttcataccaaagttttatttagcttctttaaacaaatttggtaacacaaatttgtgtaagagttttagttgacccaccactcaaattccatgtcaaacaacaaaattgtggatttcacacatcctaaactaactacaaaaggtttcatttaatgtattgattaagaatcagaatgttatagttgaaaaggactgacttcaagaagacttagttttaatattaatttggtaccttaatttgtgaagtcatttcacttctccactttccttacctttacccataaaactagggtaaaaatttttataagcctgtagttacaacaggtcaattttagctagtcctcttgagtttaattatgttgtttaccaattacatatatgggatcttgaagaaatcttttaacctccttgaatctttcagttttttcatcaataccatggctacaagagggttgttatgttatactatataagaacactagatattagaatttgctccagattgtatttagggaagaaaacattttcttgtaatgaaatagaaagttattgcaacaaaaatttcatttataaagtgggtttttttgcaggcatatgctctaaatttttctgaggcatatatttggaaaagtctgaagcacatggcattaccatattaaacagatctggaaggagccctaaggattccactgtggtacataaaagtctctcatttcccattattaaaaaaacagctcacatttttaactgtttaattgttaaggctataaattttacttataagaataatgcatattatattgtcctttactctttacatagcacttttacatacattacctaattcattctaacttcaatctgaaaagtgtgtaaagccaatgttattatgaccttttttgatgtaggtgtttattgctacaaacttaccccttagaactgcttttgaggtaacccataggtttttgtatgctgtgttttcatttttgtttgtcttaagaacattttaaacttcctttcaatttatttattaactccttagttgtttagaagcatgttaatttgtatgtatttgttaattttccaatatttcttttgttattgatttcacattttataccaccatggtcgaaaatgatacttgatatgattgcagtcttcttacagttttcagactttttgtggttttatatatgatctatcctagagaatgttttatgtttagttgaaaaaatgcatactctgcagatgttaaataaaattttctgtatatgtgtctttaggtccatttgctctagaatacattttaagtttcatgatcattttctgattttatgtttggataatctgttcattgctaaaagtgaggcactgaaattgcctactattatcatattgcagtctctctctcccttcgtatctattgatattttctttatgtgtttagatcctctgatgcttgctgcatatattgttatatcctcttgttgaattgaccactttatcatactatagtgacctcctttgtctttttaacgtcatttttgaattaaaatccattttatccgaaatatggatagctactctttcttttggtttccatttttctgaaatatcttttttcagttcttcattttcaatttgtgggtccttacaagtgaaatgagtctcttgtaggcagcatgtagttgggtcattttttttcccccccatttgtcatgctatgtttttgactggagaatttactccatttacattcagggtaactactgatagataaggacttataactgcagttttctagcttttctataaatcctttcttgttgctttttattttgtttgtgtgtgtgtatctataggattttgctttgtggttaccatggggcttattacataaaaaaattttgtagttataatagattattttaatgaatgacaatgtaactatgatcagaaaaaagaaatctctacactttgactccatttacggcccacattgtaaattcatgatgtcacaagttacattttcttaaattacatataccttcagaaattattgcaccaattatttttgatagtttttcaaacctttagactacagatatatgtgatttacataccacccttacagtattacaatattctgaatttgactgtatacttacttgtactagtcagttttatacttctaaatgtttttgtgttgcttagtaccttttttttagcttgaagaactatctttagcatttcatctaaaacaagtctggtggtgataaactcccttgggctttgtgtgttagaaaagtcttatttctcctttatttctgaaggatggctttgatgggtaagataatcttggttaataatttgttttttttctttttcttcagcactttgactctatcattccacaatctcctggcacataaggttttggctgcaaagtctgcagctaggcatgttgaaactcccttatattttatttgcttcttttctttgatggtcttagcatcctcttattatctctgattttttgagaatatgattatatctttcaatagtcttatttggattgaatctgatttttttaatgggatatttgcatatttctccaggttactaaaaatattagtaaaaacttatggaaagtactactgtatcatcttgttccacccctccatggaaatcctctgatccctatattttttatgctaaataaccgaggcttgtgaaggtaatttgttcaaaatcatggaacttagaaatgggcttcattcatcaaggcacatattttttaacaccagttttatcctgtgtgaacagactgttcattatgttaaacacagtctttgcaatactttaaacattctcatttctaagacatccagtgtggttccttatacgaattccacattgagagagtggtgtaacaattagtattagtgaatgtataaacactgctccacttaccagtgagttccaaaatgtatcgtaagctaggttttgagaattatgtttttaaaaaataatttataagtaactattaaactcatagcaagttcataataatttgaaattaacatgtttaatctttgagatgatttgtataatctttttccttttccttcttctgttgttgaatacgtaaagaatatcataggctatacagagtttcataaataggctggaagtctatgcactatttaaaaggtaatgtgatgagaaaatgtatttctgcagttaaatgagagtatgagaacactggggaatccttattttttcttaaacctttcatctcttgtattagtgttgtctaaagagagagaactaatgggatatacttatatttgaaggggattttattaggagaattaactcacactatcacaaggtgaagtaccacaataggccatctgcaagctgagcagcaaggaagccagtctgagtccccaaaccacaaaagtagggaagccgacagtgcagcctgcagtctgtggttgaaggcctgagagcccctggaaaatcactggtgtaagtccaagaatccaagagctgagtctgatgtttgagggcaggaagcagccagcatgggaaaaagatgaatgctggaagactgagcagtctcttcactccactttcttctgcctgatttattctagctgcactgacagctgattagatagtgccagccagattgagggtgggtctgtctctcacagtccactgactcaaatgttaatttcctttagcaatactctcatagacacacccaagaacaatactttgcatccttcattccaatcaagttgacactcaatattaaccatcacatctcctgaccaagtaatatccagaaaaaaaaaaaaagacaaaaccccaaaaactagtgactcgggatttttctgttgtgccaggactctttcctcaatgacttttattcaaattttggatggagcccattgtttcaatgccaggtccctacattattattttttcttacaatttcaacagatcccattttctaattagaagattggtgatgacaaaatattttttaaaaatatattgaatgagaaactttgtcatctcaatgggcataattataatacactatggcacaaaatgtggataaatattaagtagttatgttatatagccttcagaagccattggatttatgctataatgattatccataatacatttgaaaattaaggacttaacaagatctaaaagttgatcactgatgtgtgttgtttgtttaatctccagtgaaacaaaatacaaatgttactctcagtactattcccatatgcaacataatcaaataatctgtctcaataatgtatgttacaattaacacacattggaaaatctcattcctaattttccagatatgttgctgcttgtttgaagcaatgtttagagagtcacatagattccttatgcttaaaaaagtgaacaattctttactcatatatgatgagatagaattatacattctttgtatttactaatgtagtatctttctaaagtgtattttatttcacaatctatcactttgcttcagaaatgcctatggtctaatggtcctcctcaagctgtctttgaaatcatcagctttaattcttcttaatgttcaggttttctgatagttaagaggaggagtagaggtgttgacagtgatttttcatattttaccttatttctagcaattagcttttaatcaaatgtgattttcaactcttcatctgatttttcaacattgttaaaaattcagcactgatttctactatttaccagcagctggcttcagaggaaggtacagaaaaaaaaaattcattcttctcaaaatttggggatataggtatacagacaaagactatgcaaataaaaaagtacatgtaatattatattgagcatagacacacagaaacatagtgcacaaacacagggcagtccttaatatgactcctgctgatgggagtgcttcctgcaggtgaacatttcccctcaggcaatgttggaggttggaagtttcatgtaaggaatatttatattgagaatagctgcttgttgaaaactctaagaaggcttattgaccactaacattttagtatgccttttggttatctaaaaatctatgattaaaataagttaatgcattaaccacataaatatgattttttctcaattatttgcattatatgacattctttcaaaccattactcttcctggattatattgtggagaaaggaaatgagagaggattgattgactgatggattgattgattgtgagatgcaggaggaaggtttacaagccaaaaaactgcaattcccaacatggagatgagcagtcagggagggcaggtttaggagaaatgactagcaggggtttatatatggtaacagtctggtggtggcattagtggaagattgaggaacaagtacattaaatatagattttgtgttctttagacacatttaaaaaatattttgccttattttctttatactccagtgactgtggaaattccagtggtttaacagaaatgcacatttatattactgaaagctgatcgagagcaataattttcacagtaagaagagtggatctttactcagaagacctagtttgaatgtggactcattactttatagttgtgtaaattttggaaacaatatgataatatgtctatataaaaattgtcattttaaaatattttcaatatgataattttggcaagtttgttttcaggacgcatattttgaaaattaattttattttgattttgaagaaataatttggaactcatactattgaataaaaaggctaagttgtttttcttttattgaaaaaagcaataaatttcccttctagaaacttacagattttatattacttatctatattatacttgtaaatgaatggacagaaaacatttaagaagtaacaatttgtgtataaaatgctttaaaatgtgtttgttaattattagagtttctcaaaactgtaacaagcacttaatatttctatttttcctgttataaaaaacctacttcacaattttattgagaaataatttcattgtgtaacttaaatccttttaattttaaagttgtgtaagatacagatgtattgactaaattaatttaacttggatgacataatgcttagagaataaattgcaatcaaaacgagagatataaaaacagcatttaattaagaaaatatcttgtacaaatttgaagcttcttgtcatctggatgtccttgtacatctcactgggctcagtgggttatgcagaattctctgacatattaaggttaaaaattagtgtgattgtatacaaagactgttggatatgtcagcacatagatggtttggtgaaaaatgtatcaacttgaaaacatctaactagtggaagttttaatccacttttactcatccttctagttatctagtgtcgccacttcctgaggcttttgtggatgctgtgctatcaatcatcatgcttcaccagttttctcactgccaatttcagtttccaaattctcagatctcccaagtctgttaatacttgtttaattgttttttagcttccaagattttgtcttttttctcctcctgtcttattctagtgggttgctagccttaacaaatattttactaattatttgcgggatttcaggagggagtacaggtaaatctatgtaaattatttcattatctttaactggaatgctaattttaattattctatatctttcgtttaaaaagctatcaaaattcttttctacttctctacagaactgctttcaagtatagcttattctcagctttaatttttttttttttttttttttgagatgaagtctcgctctgttgcccaggctggagtgcagtggcgagatctcgggctcactgcaagcttcgcctcccaggttcacgccattctcctgccaaggcctcccaagcagctgggactacaggtgcccgccaccacgcccggctatttattttttggatttttttactagagatggggtttcaccgtgttagccaggatggtctcgatctcctgacctggtgatctgcccctctaggcctcccaaagtgctgggattacaggcgtgagccactgcgcctggcctctcagctttaaaggtacatccaaaatatgtgtggactctgcctcccatatcaggattatattacaattctgacctttggtttgttaacaatataagtttatcaacagatgctaggcctgtagtcagctatccttctagggaaacattctacattatgatatattgaactacttttcatctaaatatacaaatattagttaagcctttgctgccttcaggctgatccttacattctagaattgccttgataataattttcagtaccttatagaatattgtaaagccaatgggagactttgaatatttgatattttaaattttcaaattttgaaagttagggaaaagtgaaaataatgcaattagatgcataacttagtggaaaatataagagcacaagaagatattatgcttcactctataagcatgtcactatgaatgtaaagtcaaataaatgaaatcaaaaatgaaaaagacacattacaaataataccatagaaatataaaggatcataagagatagcaaataagaagattgaatcagtaataatgtgtttcttatcaaacaaaatccccgctgatggcttcactgctaacttctaccaaaaaattaatgaacttataccaattcttatcaaactctcccaaaatattaaagaggagggaatacttccagattcattgcgtgaagctagcattatcccattacccttatatcaaagccagataaggtcacaacaaaaagataaaattacagaccaacgtccttgaaacataagatactcctatatacttctcaacaaaatactagcaaatcaaaattgaacaacacattaaaatcattgttttccatgaacaaatgggatttatcccagggatacaaggatggttcaacctacccaaatctacaattgtgatacattatattaacagaacaaaggacaaaaatcatgtgatcatctcaatagaagcaaaaaaatcatttgacaagactcaacattccttcgtgataaaaaactctcagcaaattacgtatagaaggaatgcatctcaaagcaaaataaactatagatgataaacctacagctaatatcagaatgtgaaaagttataagctctcacattcacatttcttagatcaggaacaagactagggtgctttacatttaacgtaatcctggaagtccaagccaaagtaattagcaaagaaaaaaagataaaaggcagccaaattgaaaaagaaatagttaaattgtccctgtttacaagcaatgtaatcttatatatggaaacactaaagactcaactaaaaagaccattagaactaacaaacaaattcagcaaatttgcaaaatactaaatcaacaaaaattggtaatgtctctatatactaacaacagactatacaaaaaagaagtcaagataactgggtgatataacaaatgtttcctactatgttctgttataaagagaacagattattattgaacttatacaaataactacattgctataaaaatacaaagtactaatactttctgaattctagagagaaaaaatatttcatcttggttcacaaatatatgctttttcaaccaaatgtaaactacagctaccttaagataaaaataaaaatgttttattaaatctggaaaacaaatctttaaagaactagcaatgttttaaataaaactatcatttaaaaataaaacgaaaaataattcaagagaacaattcttgttacaaaataaataaatgaatattaaaataagtaaataagtaaaatacttaggagtaaatttaataaaagagataaaagacctgtacattgaaaacaaaacaacattgacgaaataaactgaagaaacgcaaataaagaaaacgatatcctttgttcatatgtttgaagagtaaacattgtttaaatgttcatactacccaaagtgatctacagattctatgtaatccctgtcaacatctcaatgacattctaacaaaaatagaaaaaaaaattaaaaattttgtgtggagccacaagaaaaatcctggatagccaaagcaaacttcagcaaaaagaacaaagctggaggcagcatactacttgatttcaaaatctgctaccaagctataataatcaagacagcaatagtactggcataaaacagacacacagtccaagagaacagaacagagagtccagaaacaaatatatgcatttaaggccaatgaattttggcaaagatgtcaaggaaagaatgatatcttttataaatggtgttgaggaaagtggttatccacatgcagactaataaaaataaacctttacatcacaccatgtaattaaataaactgaaaagattaaacactgaaatgtaagacctgaaactgtaaaattagttgaagaaaacattgaggaagaagttcatgacattggtctgagaaaagatttttttggatgtgaaccaaaagcataggccaaaaaagtaaaaaaaaaaaagacaaatgagattacatcaaattaaaaatcttctgcgtagcccaggaaataattaccacagtgaagaaacaacctgcagaattggagaaaatatttggaaaccatacatctgttaagagattaatatctaaaatatttaagaaactgaaacaactcagtagcaagaaaacaaatattccaactctaaaaatgagtaaagggcatgaatagactcttcttaaaagaagacaaatggccaacagtatatgaaaagaatactcaagagcactaatcagtagaaaaacataaattgaaaccacaatgaaatactacctcatgcctgttagaatggttattatctaaaagatgaaagataacaagtattcaataagatgtggcaaaaggggacacttgaacattgttgataaggatataaattagaacagccattatggaaaatggtattaggttcctcaagaaaataaaaaatagcactataatataatctagcaatcccactcctgggtatacatccaaaggtaatgaaatgagtatgtcaaaaaagatacctgcacccccatgtttattgcagcattatttgtaatagatatttataaaatcaatctaaatatccatcaatggatgaatggataaagaaaatgtagcacatatacaaaatggaatactattcagccttaaaaaaggaagaacccctgtcatttgcaagacaaaagatgaagttggggagcaccatgtaaagtgaataagccaggcacagaaagacaaatacgacatgatcttacttacatgtggaatctaaacatgttgaactcataagaaacagagagtagaatgttggttagcagggatttgggaggaggttgagaagatattggtcaaaggatatacagtgtcaattagaaggagttagttaaagatatctattgtacaaaatggtgactctagttaataacaatatattaatatattcttgaaaattgcaaagagtgtacattttaagtgttactaccacaaaaattgatatgtattgtgagatgatgtatatattgattggcttgatttagccattttacaatttatagatatttcaaaatattatgttgcacatgatagatatatacaatttgtgtcatttaatatatttaatttaaaattctaaaaaaatctgttaatctgaagacattaaagtataaaaaggaaagaaaagtcagaaacagcgagaagacatttgtataacttataactgacagaagataggtatccaaagttcactacaaacagacaaactaaaacttcaatagtctaataagaataaaagcaattaatccagtcaaataaatgtgtaaaagtcttacaaaaactcttctcaaaagagaaaatgcaaacttctaataacatgggacaaaatgctgatatttattagtattcagggaatgctgatatttattagtattcagagaatgtaattactctgattaagattttttttaaataactatcttattggcaaaaattttgcagtctgaaaattccaggtgtttccaagattttaaaatagctagaacagttatataatgtcagtagggctagaaataggtgatagcatttgaaaaactgatttgacataattaagaaaaatttaatttttttaccctctatgatctagcaagtccaattgtatgcttacatcctgaagaaactcttgcttatatgtactaggaagtatgcaatattcatcaacatggtaaattctaatgagttgatcaaaaagaagaattagggcctggagattgatcagttctgcctgctacagctggcatctgtgcacaacatctggaggaacctgagggaaggaccaccccacttattaccaccactgaagacatccacgcacacattctgggtacatgagaatgagcctgctttcccaccactactgcttgtgtacattactggggacctagccataggcctgctctgcacactgctaccagtatatggaagtatcatccagaggaataagggagtgcccaccccacccacagctggcacctgcatgcaccttttggggacccagggatcagcctactcagcttgccactgccactgctggcacccatctgcatatgccactcaaggggtttggggattggcctgtccagcctgttaatgacactgctgccactcatgggcttcagggttggccggcatctgctactaccaccattaacaacatgtatactacttgggggtcaagggactaattcatgcactcaacccaccactgccactgccagcacccaagcaagctgtctggagacctgagaaccagcctgcccagacccatcaataccactgcccacaccaccaccagtggcccaaagatcagcacatccagcttgttgccatcattacaggtgtccaaggactggactgcctggcatccttgttcccaacaaagccttgtcacagcctccaataataaacacagcctaagctactgaggaactgacaccgctgccactgattacagctaaagaactcacacgaagattacattactgtgtccatttagaatcaacctttcctgaacaacatcataaatacatttttgggaaatgtctttccttatgaacaccaatccaaacaattgcaagaagtgactgtttcatgtttcttgtgtctttacgttgatacacagatatgagaaaccaaaatattatgacaactccaaagtaacaaaataattctctccctttttaaagcttttattttatgttcaggggtacgtgtgcaagtttgttgcaaaggtaaattgcatgtcacaggaacttggtgtacagattatttgatcacacaggtaataaaacatactacccaatatgtattttttgatcctcaccctcctcccaccctccaccttcaagtaggtcctggtgtctgctgttcctttctttgtgtccaaatgtactcaatgtttagctcccacttacaagtgagaacatgtggtatttggttttctgttcccgagttagtttgcttagaataatggcttccaatttcatctttgttgctgtaaaggacattacctcattttttcatggctgtgtagtattccgtggtgtatacatatcatgctttctttatccagtctgccattgatgggcatttacatttattctatgtctttgctattgtgactagtgctgcagtgaacacacatgtgcatgtgtctttttggtaggatgatttatactcctttgggtatatacccaatgttgggatttctgggtcaattctgttttaagttctttgagaaattgccaaactggtttccacaatggctcaaataatttacattctcaacagcagtgtataaattttcttttttctctgcaacctcgcgagcatctgttattttttgactttttaataacagccattttgactggtgtgagacggtatcttattgtgattttgatttgcatttttctaataatctgctaagcaactctaataataaaactaggatgtgggcggcaagccacccaggtgccgaggcaggagaccgagggcaccagctgttccagtataataaaatataaaacaagaatagttataccagatatagatcttagatatgattatatataaatataattaatcattagttagtagtacttactctttattccaatgttataataatcctcgctctataatcgtaaccgaggaaaggccaggccatacagagataggagctgaggggacataatgagaagtgaccagaagacaagagtgcgagccttctgttatgtccagacagggccaccagagggctccttggtctagcggtgacgccagcttctgggaagacgccccttgccaagcggaccgtagtctagggatagcgttagtgtcaaggaaaaacacccgctacttagtggaccgggaaagggagtctccctttccctgggggagtttagagaagactctactcctacacctcttgtggagggcctgacattagtcaggcccacccacagttatccagaggcctaaccgtctccctgtgatgctgtgcttcagtggtcacgctcctagtccgccttcacgttccatcctgtacacctggctctgccttttagataatagtagcaaaattagtgaaagtactaaaagtctctgatatgcaaaaataatgctgtaagctgtttctctctctccctctctctctctgccttggctgccaggcagggaagggccccctatccaatggacacgtgacccacgtgaccttacctatcactggagatggctcacactccttatcctgcccctttgtcttgtatccaataaatatcagcgcagcctggcattcagggccactaccggtctctgcgtcttggtggtagtggtcccccgggcccagttgtcttttctctctttgtcttgtgtctttatttctacgctctcttgtctccacacacagcgaaaaacccatggaccctgtggggctggaccctacactaggaaattctggaaaaataattagaaatagtgatattaaagaaattgtgaggtaacacagaatacagataaacaatagaaaaacaatcagggaaacagttgataatctgaatgagaaattaaaaaacaaaatagatattatttaaaaataactaaatagaaattctagaattgaatgactcattgaatgaaatgaaaaatacaatcaagatcttcaaccacagactagatcggggtgtccaatcttttgccctggtttacactggaagaagaagaattgtcttgggccacacataaaatacactaactatagctaatgagctaaaaaaatgcaaaaagtctcataatgttttaagaaagcttacaaattactgttgggccacatcctaaggcatccaaggctgcatatggcccatgggctgcaagttggacaaacttggactagcttaagcagaagaaaaaatttccaaacttgaagataagtcttttatgctaacactgacaaaaacaaagaaaaaaaggaatacataagaataaaaaaagccaacaggacatatgggacaccataaagagaacaaatatttgaattttgagaattttagaaggagatgagttggacaaaggcatagaaaacctatttaacaaaattatagcttaaaacttcccaaggcttccaagagacatagacatccatacataaaaagctgaaggatccccaaatagactcaacccaaaaagccttcttccaagggacactattgtcatactgtcaaaagtcaaagacaaagggagaactgtataaacagaaagagaaaaaggcatcaagtcacataagggtaggagagactgggaggataaatttaagtaccaaaagaaaaaaattctgcaggtcaagaatattatatccacaagaaaagtatgcccacgttccttactcttatttaacatagcattggaattttaggtagagcaattagacaagaacgaaaaataaaagccatcaagattagaaaagaggaagtcaaattgtctctgtttgcaggtgatataatcctatgtagagaaaagcctaaagactaggccaaaagacacttagaattgatttaaaaagttcagtaaagcccagacacaaaatcaatatacaaaaatcaatagtgtttctatataccaacaacaaagaagctgaaaaattaatcaagaaaataatcctattcacaataactacaaaaatacctaggaataaatttaacaaaggagttaaaagacctctataagggaaacaacaaaacactgatgaaataaattgaaggggccacaagcaaatgaaaggatactcaatgctcatggatcagaagaattaatattttttaaatgaacacacttctaaaagcaatctacaaagccaatgcaatctgtatcacaataccaatgacattcttcacagaactagaaaatagcaatgctacaatttgtatggaatcacaatactccaaataaccaaagcaatattgagcaaaaagaacaaagctggaagcatcacactctttgatgggggagatgaagagagttggctaatatgtacaaacatataattagatagaagacataagttctagtcttcaatagcacagtagggtgactgtagttaacaacttattttatatttcataagagctagaagcaaaaactgaaatgttcccaacacaaaaaaaatttgaggtgatagatatcttaaatactttcatttgatcattacacattgtgtacatgtattacgatatcagagatttcctgtttgctttatagtaattctggaaatgtactgtggattactacacaaaaatgtactataaaaggaaatggaaagaccaaattaaaatacaagtcaaatacagctacaagattctaggtgtccataagccttcacatctggtgatcttgctaatgcaggccaagtaaatatggtcctgctgctgtcactgccatttttatcattttgtttgatagaggtgagaaggagcctctatgggtcagttctcccagttatttgagactgttcttcacgtggcccattacagattgatttatttcagaagtcaacatgggagaagtgtggtgataagaatgcagatcagaagaaaaacacacaatcaaatttggttaatagatttggggtgtttataaaaccaactgtttccccctcattttgacttgaaagatacatatttggccaccttcagaatatcaaactcaggttttacttttctgagaaacacaaaatataactttaagtctgtttgctcatcaatttaatgaggaatttgagaaaccatgtaaatatttcacatataaaatttagaaaaacgatgtattacctcaatagaaggaatttaaatatgatataggcacatcaaagatagagagaaagtatttctcaaataccaatttacaccctgacacttattcataaaaaataatacttaggtgcacttagatgagacacaatacaaagaagttaggggtagaagcagctaaaaatcactgtaatgacatcctttaataatcccacacataccattccttagttgtaaagcatacctttgtgaggagattcaactaaaaacactttgttatcccatgaaagatgaaagactgtacttttacaaactaaagtgagttaaaattgtaatatttagcctgcaattttgccacaagaaattactaattttcagctttgatctttcatttattttgatgaaaaaatatgtttatgatagttactatccagcatttattagtcaacttatactcattaggcaaccaatgaagatttagaagaaaatgagaagtttctgaaataaaagaggaagatatatgtgtaattttataaaactctggggatatttgctttcttataactttatgtatttggtaacattatgagttgaaatataaaagtctaagtttaatcagtaacaatcatgcggtgttctttattaggttaaagagtatagcaaatttagtggcatactaatgttacagcatttatcttaatgtgaaatatttactcaatgatgtagcacacaaaatattattacaagtaaatactttaacatgaataaatagaaataatggtaattggtattcataagtcagtctgcagtcagtaccaactgacacacttaaagactaatgaatgaaaaatttgctaatatgacctttctggattttatgattacagcaacaacatggaaatctttaagccatttacaaagtaaatattagtaaatgataaatacaattatgtcagttaaatttcaacaaaaacggtaaataaaagaccgtgtgtctatttccaaattaaaaatgtgttccattaccttttgatagatgttagaatgatagaagccattaattatgtaatcagtgctacaaattggcacaactagaagcaagatctctgggactcccactttgggactcacggatcaccagccagaatgggtctcacatagtgtcatctgtcgtcaacatgattttagataagactgtagaccgcctatgggaacatgacttagttattggtttcagaaaaattttgtgctggaaaaataagactaaaccaataaataacttcaccttttgtttcaagacattcttatcaagaaacaattatttgctcaactggtcaaaatgagtttacttatcaacaaccttaattatgctcattaattataaattcttatatccccatttttgtccatttttagttccccaacctaaaaggccctcttctttgatcatctgaaccttccctccagagcccggtaaatatcttatttctaactttctcctctgtgacactgcttatattctgtcaataaatgtggtgttttttatccactgtagtgagctataataaacttatttttgttcattatcagacacagatgtttcagtgacttctatatataaatttataacttgttcaactaaggctagcataaatcttcaatgatattttcctattattaaagtataatgaaattacacatatgtgataccatggggggttatttccctgttctagaaacagggtgactaggaaatagcacatatattttctagtagcataaactcaacctttatttttctttgttcataaagattattgcttagaattatagaatgaatatgaaagaacattttaaaaacaactcttcagtccttttggcatcccagaagcttattagttataaatttgcatactcgagatgacaggcaccacagatcataacttttcacttcctgctattaatattgatggccatggtgaattactagttcatcagaattgatttgacatagtaaattttcatgtacagtagactgtttcacaaacctgcatcagaagaaggtctttgttaagatgtagcatggttagtactcaagaagaacaatacagtatatttgttaaacaatctttgtagtcagaaagcctaggttaaatttgctaacctgagaggctttgggtaatttactgaaacttcagttttcctcaactaccaaatgatatagcatttgtgttgtttcagtggtacttttcacttatgttcctctttttggctacagtaaaggagaggaaacacatcattcaggaaaatggacagccacattttctttgaagctgagctgattctcctgggtctcttggccatgaggcaatggccaacgggaaatataggtgagaaaacataaatttacaaatatctttctgttttattttacattataattaagtcagcagaatactatcaagtttgaattaccaaagatatttttgtgttcacaagttcttataactctttcccaatgtctctccttaatttgacaagttttctcatgtggtatcatacactgtatttctgcctcatattatactccacaaataggttctacttcatagtttgctctgaatagtaaatgaaaagaaaaggccgggcgcggtggctcacgcctgtaatcccagcactttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaaaataccaaatacttaacacagttcctggcacatagaaaacacttcatatcaggtaaatatcatcatgattgtgtcctcggcccaattcttgctctattaaaaaagtcacttaaacacccaaagccttaacttcctcttttttaaaatggtaaaaggaataaaaaaaaatcatttaatttgtatgattgttgtattaaaacattactgttgtgatgttttttaagagacaagctctccattgcccaggggctggagtgcaatagcatgttcatagctcactgtaacctcaaactcctgggctcaagctatcttcccacctcagcctcccaagtagctaaggctacaggtacatgccagcatgctcagttatttttttgaaataacttttgtagaaaccgtgtcttgctatgttgtctaagctggtctgaaactactggcctcgagcgatcttcctcccttggcctcccaaagtgctaggattacaggtgtaagccactgttcccaggtttgttctgacttttctatttttaaaaaaagaaaatcattaggccattcagcccagggagcttttaattagcaatcctggacaacaatagttaattcctcctcactgccatctgtgcatgctgccctcctgtccctggtgcctttacttgtagttaactattcgcatgtctgtctttatattgcatgcttctatagcatgagtcacatttcagatgctccctgaaggtctgctacattaacatgtgaataaataacataaaaagaagtgatgtattaatattattttttgaagtaagctacctgtttctccacttccagatttagagagcatagaaaaagcactttcagaatgataaaatagtacaaactctccccagaagatctctgggtatatccaaggtgatacagttaactctgttgcagagtgaaaaaaatatagaaaatattttttttctttttcaaaaagcctctattaattgaaaaaaggtgatcattttgaatttttctggatcctcactgctcttttcatctcagaagtgccaattatgttagtcatttggctctatattcattattattgccaaagtgatacaagccaatgtcaatttaaaataatttatttccttcaaagatatttaaatatgtcataagggaacacacaagcatattttctaacacttgtataaattttctgatttgtcaataaaaagtatacctcaagctaaaaattaatgagcccaaacatcttacataatactgtgcaaatgacactattcagtttctcatcgacttgatgttgtttagggaagttatagttttatgaaatgcacatgttacatctacctagtagccatattttactattataaaatacagaggaattcatttagtggaatgtaggaatataattctctaatatgacaaaaagaaagaagattatcttccctgtcattttcaaccaattttcaagaaagtccccaaccaatgactcaccaaggccctcacaccagcccccacagttttttcaatgtgaattatgctttcccttcaagggttctacacgtcgtttctcttcagtgactttgtttttgattcttcaatgaaaaataatgttttcttctcttgccaccacctacagatttaatgctgcacttgcatcctctattttgctaataccaatacatatgtactgtttaacctgttggagaataagctacttgagcatagggacataactcatattttatttaaaatcccctccccatcaccttgtagtgttatttattttggaagccttaactttatataattttataattagaagacagcttttgatatactcacttcaaactcatgttttgtgctgtggtcagtaaataatttgccctctgcctcatcctgtctgacgtctgatgtataaatggaattggaagtatgcttccttttctttccacatggcccgttgctgatcacctcctgacccacggccacccttttattcactgctgttgtgtcaaaggagatgtatcttcaatcttctgcttataatttatccatacttttcactagaaatgatggtaaaccatggtattattcataagtgttttggaaatgttacaagataaataggggccaatgagccagctgagaaacactactctactgagatattgcttcaaaaggaaacatgtgtttcatgtttaaaaatacgtggtttgaaaaaaaatctttcaaaattaaagcaatgcagaacatcaaaaatatttcagaaaatatttgtgttgaaatcagtaccctcctatttgttggctcaatgggtcaaacaatccatagtctttccatctcagttttgttatctgtaaaatagacctctgatttttattcctgtcattaccattcatctcactcccagcaaaagcactatgtaccattattatgaacttgctgttatgtgcttgtgtgcatcccttctacttctgtagaaagttttccaccattgtgtccttaatatactgagttttacatcaaaattcaacacagatactgaatttctctgtaaaaccctaccatctattaaaaaaggtgtttaagtgctctgattagctatattcttattaccttttgcatgcaattttattaatatattatgttttcaatcatatttacttttaaaaatgccttttcccccatttgaatgtaaaattttaggggctagaactgtgtttttatgtctttccagctcagaaacttgaataatgtacataatagatgcttactaaaatcagttgaatggatggaaaaaataatttagacaattttaatatttaaatgtttttaaatattaaaattatttctatatttaaaagctctgcaaaaggaaatacattattgccagtatttgtcataattttttcataatattaaatgatccatttgtcacttcatttttttaacttctatttttgtctgttacttctatttgatgactgatatagtaaaaatattaataatactaatatttatatagtctacactgtgtcagataattcaagtgctttataaatattattttatttaatacccataataatcttatgaagtaggcaacattacaatcccaatttaatatgggtaaactatggccttgagaatatatgtattttatctgtttaactctattatttaaaaataatctatagtataataatagtaattgattttatcttaatttaaaaataattttcttatgaatttataaggacagaaaggtatcaaagtaatttcattgaaatagtctattttattttttcagggttttagataaataaaagaatatacagtttatcctctttatatgtaaactagctgaaggcaaccttgttagatagtaatgtaattgtcaagataaggtattcccagaagtttattcaatgtcatatattgtgtagagaaatcacaatgtttaacatttttcttatactatcaaaatcaccaatatagtaaaaaatgtaatgaaagttaatctttaggtaacgtggtatagtaaaaagtgctttgaattaattatcaagagattagcattacagttctttatgtctttctaataacattatggctctcataagctgttgtctgaactatggcaaaaacctgttaaccaacctcaagacccagtcctctcctaggattcttcacactgcagaattactttccccttaacagttttgattacgtcactttactgctccatgatattgcctgctccataaaattcaaactatttagcagaacattcaagacctttcaaagaatgtcactttctaattttgccatttactttacattactgcccattattaccaactcccaccaatctcttactgtaaatgccaactgcactggacaattgactcttgtctgtcacactgggcaatgcatcattccctgaactataaatgcttggctgtttgttttaaatccttttttctccaaatatgaggccactttttttgttcctgaagtttaaccttgccttagtctacagtactattcctatatttagagataatttaaagcattttaaaccagaagattaaactacttctcaacacttttaaacagctgtactgacatgctattagatactgaattatttctgtagatgctgaatttatcaggataggctaggttaaactggagtagcaaaaaacacccaaatctgcatggcataatacaataaagtttatttttttcattttcttatattgcacaaagtgaatgaactgactgttgagagccttagagagttctgaaaatattggagcaacaacaataaaaatagagcaagtctgttgtcaccaaagtgggagtttgaaatgcagcttccaaatgagcattcagattggtgtgaaaatcagtctcatgagtccgttgctatgcctcacatatacacatgcggaaatcatgggcaagctttttcaagcgagtagtaattgttctaaccctatataaaaatgttatttcattcactctctccagttgtagtggtctgctaaataccactagtaactcatgtaatactcattgaagattttttgaagtctgatatcttatacatggaagctggaaattttatttcttatgggtgtgaaccattcatatgtacacctccaggagttatagtaaatatcaattctttatctttaaatttgtcattaaacaactctattaccatatattagtcataccaatggatagctaatatgatttaaaagatgtgctaccaaattttatctcaacttgcaaacaatttaattgtggatattcttgtaaactttaaaatatattttccccacagtaattctcatccttaaaaatgggaagagtgaagaaaaagttaatctttgtgcgatgttagagttcagctaacgttgataagactaaatgaaagtttgcagcctaaggggtgacaaaacataaaatatattccagaattaagcattgattagtaagaagcaaactaaaatgtgcagattaaatgtcagatattgaaattctctgctgtttcattattgttgatagcagtaaacgttataaatctcaaatttaccaggcagaatgtcatgtaatttgtcaaatgcagtttagctaaaatgaggtttgtcgcttacacaatcaacttgttaatttggctggcacttattctactgctgttacataaattctcaactataagctacaacatacattttaatttgctggacatcaggttaaacaaaaaaatatgtattcattcaagttatgttgtagttacactgattattgtcatcagacttttccaagacttttttttcaggtattgattcaaattaaagtcagaatataccacattttcacaaataaccttgatgtctattatcctttactcttttcacaattatagtttttgaaaaagtccaatatttcaggtgaacagttttccttaaatatgacttattttggttctgaatgtatttaatgtgctgtttatttttgccattattataaaaagccactgaaaactcacagctttctctttattcagaatgcaaacagccaaaaaatcatatatatgatatatatatgattacatataatcatatgtgtttgtatatatacatctcttatgtgtatggtgtgtgtgtgtatatatatatatatatatatataattagagagcatagaaaaagcattttcagaatgataaaatagtacaaactcttcccagaatatctctgggtgtatccaaggtgatacagttaactctgttgcagagtgaaaaaaatacagaatttttttttctttttcaaaaagcctctattaattgaagaaaggtgatcattttgaatttctctgaaattcaaagcaaaaaaaattatttttgttttctcacacacacacatacacatatatacatacttaaagaaaacctcttttagagattaatacgaaatttagtataaattcagctcgaattcatgtcatagaatgttagtcctgaaacaaactcagagaacatatttaaatttctcatcttcaaagagaaaacggcctgagaggcctgaattaatgtgatcaaagaatctcggtgttacatagaagatcaaaataagaacccagatctactcaagccaagtgttcattccagtgtatcttcagtgtatgagctcaaaattccaagctattttaaaatacctactttgtgcaaataaaagttagacaaagtgcttaatatctgttctctatatttaaggatttaagtgtgatttaatgttttattagtcaggacatttcagctactaataccaaaaaagaaactcaaacagcatgttaaaagtaagttaatgcatatattcacctgggacaacggaggtgaggtgagctcaggtttggttaactcagccctattctaatgttaccaagtctctttccatagcacatttatcctgaggttaactcaatcagtgactgctagaaacaatcagaattatattttttagctcttactcaatgaaacaaaaaataaattgctttttttcttagaaggtactagcaatggggatttttctacttcattggtctaaggtaacttagcctgtccattcctgatccactcacttacaaggggaatagggtcaatattttggcttatgcagccactggggagtggatgttggggactcaaatgtccattatctatatatcagtttatttataattaggtagcattggccaccatatatgattcatttcaaaatactttgcctatatatgtgtaagttagccagggatttaactttttaagaagatagcttatttttttcaaatatggctctgccatttttattgatatgacaaaagtacttaagttctatgtgcctcagtttactcatcagtttaatggacatagtagtttctatctcacagatttttgaagaaagaatgaatacagtaaatagcttacaatgttgtatgacatatagcaaatgttttatcagtgtaatgtagaacgattattgtattatggttgttgatattgttatcattgtcttattattgatatgacaacacagaaattgtattttagcacaaagatttaagaaaaattctttttgcttacaatttgcatctggtgggaactaacatcttacaaaaagtgttgcaaacagtagctaacaatttttttacctgcagatgactaagtatattttttctatgttacttcctcaatgaacttcttgctacttcctcaaataaagtattttcataggttccaaattagaaataaaagccatagcagtggcagcgtccactgacctcctttattaaacagtgagtgggatcactgaactattctatcaacaaatttatcaagatctactctgttggccactagagctgacctgaatatgatcaagttatgtttcctgtgtctaggacagagaataacaatttttttttctgcaaagggccagatagtaaatatttcaggctttgtgggttatggggttctaacacaaatattaagctctacctctatagtgtgaaaagccatggacaatatgtaaatataataaataggcataaccatgttccaataaaattttacttaccaaaaagtatgtggaacgttctatgaaatgagggtaagacttccctgctgtctccccttcaaggagtaaaacacttaaaccctatggttaaacaaaaatgtggctgaggatatcaggtcaagagtattaaaaactgggaaacgttggaggtgctgaagaattctacattcccaacatcagtggcttctttcatgtgaaaggagttcttttaaattcttccttagctcaagcttctctctcacttctcactagggaagaggaaattatttaactgatttgtaatttcagaattagaatacacctccttttcctacctccttctctctggtgacccccaggaattaaattactctctgcttcttcatagttttgaagaggcaggctctgtttctgaatagggaagcctgccccaatctagtgccaataaccaggtaagtctgattccctgaatagatatttagcaagtcacttgccctcagatgcaagctacattctagtgttagcttcattaataataaaggtgatattttgatctctcatatttctaagccataaatcactacttatctatgatttattttatttcagactttaatagggaagggaggtgctgtttattgtgtgctttctaaaattctaacatgtattgtcttattcatgacacatagacatagattacaatttttcagaggctttttacgaactcagctagtgtttgcaacacttttgtaggtgggcattaagttttaatatggggaaaataactttgatcttggcagtcggcagaggctaaattgagcaattagatgttcttcaattgactttttaaatgtgtctttagactgagtgaaaatcacacaggattttcagcatgttaggacacatcagtttatggtgttcctgtttatagataggccaccttcctgtgtatcttaagggagtggcatgaaggccttacctactttaagcaaaagagattgcctctaatttcagtcagaccatgaataccttcacccaatactggctgtgtacaagcctactaaacaaagtcagattatgttgattcagcaaagttatggggttctgcagagactgcacctcagcaaagggcataagagcaaaaaaaaaaaagtagctgttgcaagctttagtaaaaatgctgctcatgcatgtcagaaagcacaatcatgggcttgcaagtttgaatgaagggcccactccaacgctttaactggcttggttggccttaggtataggcagctatggcttgacattgaactacttaggtttttcttacacagtcatggctgaggctaacatatgatataggaaaaggatggtattcatactggcattaagcatttgtgagtagcataacatttgttactttaaattataagatgaattattcctgtggatgctctagttaagatttacttttaaatcatctgtgcttagaccaaggcagtgttatattaagtaccccaaattccagtgggtacttaggaccgaggaaaattcaaatccttgtcctcaggattaagggccataaaactctccagagactaaatgagttgcaaagataacaaaggtaagaaatacaacacatcttcaaggacatttacggaattagggctctgaggaaaggaaagagagccaggcaagacaagccaaggcctggcctgagttaaatgctattctaataagaggtatccactagatatgattttcaaacaaaaatgtgaagggaataaatacttgattgaacagtagatgcttgtgtcagactcagagcttactgatttaggaatatgaaagaaaaaacaaatatttgggccacaaagtggcccccaaaaaaggaaagaaagggttgagaccaaggaaagaaagtgctgcctctactgtgttagaaataagggtccagcttaaggagcaggttaaattgctaagcacttgctgaattggcctgtaggaaggaagagaagaacagggaaatgttagagaaccctttaggattaagaaaagacaatgtatttagtagcccatgacagaagattgggttttctctaagccattaggaggccaaaacttgaaaaacaacagaagcttcagtttaagactgcattgaggataattctccaactgaaagaaacctaaggatgttaagagaagtttccataggcagtatgtgacagtggactgactatgtatttatttatgtttttgctcaataggcaacaactccttgtttaactattcattgatccaaaccaaggtggtgaaaaaatcactgttcagtgtgtcttttccctttccaaacctaacacccactcaatgtcctgattactaggctctagcagaaatccagagaacatttcctagttttctataatcatttcacttagaaaatcctctcaatgattatagaagattagttctgagccccaagattgctaaccaccaaatgaagcatgtcatatactcagttgaggatgctattagtaaattcctccaaaataaagcacttcagatggactgaatttcatataatgaatccaaaggcaaatatgtattaattattgggcctaagggttattgaagtagactagtgccaatgtttactattcattaatttattagtcaacaaatattcatatttctatattatgattatataaatactgaggatttatatttaaagataatagcagactcagaaagaacccaagagaaaatagacaaaggaaattatatgctggttttaaagaagtaatagctatttaaaaagtattgtttttccactgtaaccttttattgtaatcaaatgtgattaaacctagttacagagaatctcaaaattctgtgaatacagggtttgtaatattagaaataaaaaggttaaatacttaattcctgggacttagactgttttgtgacatggaaagttatgcttaaattggctcaaagtaaagcgagaatacagttatttctgtggctttgcaaaatgacatatcacaatcaattccataatattttagttttaaaaaatatcctctgtgagaaacaaagtatcttacagtatcttgcattgtcttacaactcgctccagagtatctgtcagataacaagagatcaacagctatgatgcaccaacaaaatccaaaagaattcaagggattttgaataataggttatttttaaagaggtagcattttgttagttttacaatcatcatggtgtatataactcattgtcaaattattgatttaacatatttactgctaagtagacacgggcacaattattacagttgatgaattgcttgcacattggcagagcagcaggcatgcggtctgtatgttaaaaatataaacttcaattagaagctatccctggatctgtttctaaggaaaactatccatgtgttccacatgatcaattctggaataaaccaaaagtcaacgtagaataatatagaatcatgaatccccaaggaaccctaaagggtcatctaattcagcctgtggctgccttcacataaatcatccaggcttaatgaactttggaaggcttttaagagagataactagggaaggaggtgaccatattcctagaagtggaatcttctcctgcaaagagcctacagccattctgttacaatttacactaatttattattttttacagttaatacactagaaaatacaggtcactataataaatgacatagctaggataattattctagttcagaatttcagaatattggtccaagcttttttcctcatacaccatcattatagtacaggtaaaaaggaatgcaaagataaggttttctaaacattggctcattaaaaaaatcatttagcatttgtgtgtaaactgatctatagagatttattggcacttaatcaagagagacagtttggagtgctttttcatgctaagcagacataacatttttgaagaaaatcttagaaagagagaatcttattacagccgccactttatatgacagtttattattgccaaaatgtttgttaatgtataaactgcttatacattattcttaacctgaaatcatatagagagagcaaaaagagaaagaaacaaaaaacagctgaaaaatggtaatgatatatgcacttttcagaaatataataccatagaaaactaaaaccatatctaatctatttaggtcatttccttagtacagcaacaataaaataagcataattgggaattaatatccatttaaaatgtatattaaaatattgcttatgtcctaacaaaattatcagtgaagtgtcaatataaatattttagaactaaaagaagataaaaagctgatattaatccttatcttttttcatttattttaaaactataaggatatattaaatgtgggatactatcaataatttcacagttttataatttttatgtgtactttctagtgagtatttacatatgttattttttaaactgtacaatatgcctctgtactagattgtaaaggtgtacctacagcataatattttttaatttatatcaatacctattatttgagtatttactatgtgttagtgctagaagtcaaaaccaatagaaatataaaagtagttctaggcctcaagggatatgaacaattagtcatacctttgtttttctagaataaattttacagaacttaaatctaatgtaatatatgaacccagatcccagttgaacaaaatgtctcaaaccactggatggcaacatgagattttctacatttaattacctatgttatctgtaagttcaacccaattatttgtatagttcatacttgattaaatttggttttaaatacatgaaactgttaagttgttttgacctattttcaaaaaaggatggaagatttttaggtaatacaatttaaaaaaataatctcttctgataattcaatattaataaattcaccagaagaattttcaaatacccttaatttggccaaattctaagctagaagtaggaagtcaagcaaatataatagcaagtataattgcttggctcagccaaacttggacttcagaatcactccagatataacaatcatacaattgcatgctcactggcagattctctccttttacctggaaagtgctcataaaatcaaaaagagatgtaattgtttacaaagtgctattgtggttggcaccatgggacacccagtttactgtgttgtaatagactattgttaaaatgaaattaaacagatgagtattcactatttattatttataagacactctgccatatgcaaatgcaaatagataattggccaagaaattatttcaaaacaaagtctgggaaaattctcatgtataaataactttagaacaaagaagactaactatgtttataataaaaataaaatagagtacacatgaattaattaaaacaaattatctgcttaaatattcttcagtgaaaagtaaacgtagcagaggcaacatgtagatagcatgctaaagttacaagactttgtcatcgtatccatggaaaagtatataggctttggaaatatgcttctaatattcaacctttctgtgcttctttgtaataggagaataaaatccagagttgttaggagaagtaacaagttaatactcgtaaagtgatttgtatggtgccaggcacatagtaaacctttaggaattatttgatattatttaatctatttctatatgatctgatactttgtttcttacttagcacagtagagcacatttttcattatgttatggtaatgctttagttggagaagaatgatgaaaaaatgctgtctcatagaaagacaaaagaactatgaagaacccagctttctgttctttagttttcagtgctcacatactgcttttttatggagagatttattagagattagagaacttgcaatgtaagaaaatatgttcacaggttttactgaaatttataatatatcattgtacatagaccatagaaatataaaatctaacttcaaaatactttttgctaagtggattttaactgtggttaaggggctttcaaattcaaatttgtaaaacactagtctctagtggtcagacaattgagcttttcttttttgtatacacatgtgtacttgtggtgtgttaagtgtacatatcaatatgcataatattttcacgatgtaaataaatccatttactagttattcaaaatagaaaaaagtatgccaatattggaaatataaaaatttactatagattttatattaaaatatcaatataaatattttaattaatataaaaattttaatataaaaatattttatgttaaaatattaaattttaatataaaatattcagttttaatataaaatctactaatttcttatttttgttttaggtacttgttaatgcaatgtttcttctatcagcttagactgatagaatattgacattagataaattgaaattctgatttttttaaaataacgtacttcatcaaaaggcataacatgaaccatttgtttcctcattaaaatgttaaggagttggcatctaacattacatatttttatatacttctggttacatattgtggagccctttacaaaggttgtcttctttctgaattcatgattaatctttagaggacacatgcttcatgaagaggcctcacaaatgaataacgtaatgatagtgactcaagcacactttggcacagtctgaaaaggcagtcacccagcaaagcaattaatgtcagaactaatttagttctcagcgaattttattaatgattagaatgtttattcatttaaaaaactctgtctctctatagcatgaattgaaactgtgaattaagaagtgaacaataggtatccttccttttcatgaaagtggaaatctagggttcagaccgaattgcaatgtagggaacctgggccatataagactattgccccgaataacaatataatacactaaaactgaaaatgaatggtcaacagttaataaatattgagcatctaccatataccaagcacaataccatatgttttataagatttcctcaagtaaaatattttcttttagtgactagttataaaatatgtcatggtagttaaaagatagaaggtaatgtctaactgtttaattttgtcatacaaatcaatattttacaatacacattaaaagcaatttttatcatcaataacagaggcaaactcttataactcagagtccaaatatttatgcttttaatttatttgtaattaatgatgacagaaacctctggtttgtggtatgtgtatctctccagcattcaaattaagatgtgaatgcttcaagtcagattacaaggaataataatataaggccttttaaaattcaacgcagtgcaataaaatgtgtagtattacaagaaatgaagtaactagacagacgaaagattcataaatattgaaaaagcaaaggaactttttaaatttttttcagtatattaatgactaaaatgttgggaactgagattagcattaaccacagacaaatggacagtgcttggaagaataaaaatgtattttaaaacttctatataaagcatcagtttttactatgcataaaaccacacttttttgttttaatcatgcatattatgtggtagaactattaaaagagaggaaacctttaaatacatcaacaccacagacactaaaatcaacagaaaattttaagttttaaaaattgcacaaagtctacagaaacccagtaatttatcctaccaatgaactaattatttattaggttgaaatgaccaacattaactaatatttggaggaaaaggatggggtggataataataagaagaagaatatcatccaatatgaagagcttttaatgggatctatgtaattgtttggagacaactatatccacaagcttataaagcaatttaaatgttaaacctaaatttagaaaaaatattatgtttgcacataaagctttgttaccctaaaatgaaaagtaacaaaataaaccacaactccttatttaactatggaatatttctgaccatcttatcttagaaaaaaaaatctttaaactcctcaaaatatatatttacttgatagaaattagatttttcaaattattatctccttgagtatcaggcaagtttcaattctaatagacattttcaaattttcagaaatatttttactgaacccagagaatactaagaaaatatttgaaatttttatttaaactttatgcaaataatagctaacaaaaaatatttatttacatttctttgtgccagtactggtctagacactttttacggtctcaactttaacggctaatgtaatattcataaactatcttataaaataagtaccattatcctctctttgcagatgagtaaactgaggcacagagagtgctaaaatatattgcctgagataacacatatagtgtttcaaagacataactcacaagcagagcttatacccttaaactcttataagctatgttataaaggtgactttgtactgcaggtttcttataaaagtaaattattcttctctctgttaatgtcataatgcaagaaaataagataaacattaataatcattaagcatacacttaaatagcatgtgctattccttgttctaaacactttacatatattaatccctttaatgccaagagattttaatcatagaacttcaagcctggaatgtacagcacccttattttatgagaatgctatagccaagagaaaacaagcaacacccagaaaattgttaactttgacaattgaagaaatttgaagtaatttttgtattacttattgtactatgcatataacctatatcttttttcaataataaatcaatttattagttacataaaagagtatgtaattgctacatcagaaatgagaaagtgggaaatgtgaaaggtaaattgtcaaaagttcataaatataattaaataggatcaatgtctgaagtccatgtattcataaccaaattctaatgatttctgctgagtattattcaatacttaacatacatttgtagacatttttgtttcacagtcatttttaagaacgtgttgtatgtctaaaactatgctaggcaattttgacacagattaaaatatgcccctttgcttacatatggagccatctgaagtcccagttcatgctggtcctgtttttttgttgttgttgttgttgttgttttctatttagcctttgtcttgaatgagagtgtcctaatttggatgttgcccccacacacaccaaaagattctggattttagtcatgacgaagacaaggaattatgtaattaaccttcttaaatattagtttgaagaatatacaagatgctgggtgtgtggagaagaacaattaactctacccagggagttacttcggagatctacagctggaatggaggattaaaaatggaatgggaatccatcaggtggttaaagtgatgatagacatgaggaagtaatgtagagagaagcaaataaattagtacagatagcatttagcagagatacagtaaaaggagagactagtctgggtcaaactgaatgtttcagtcagtgccttctctgctttaagcacagttctagaggctaaagatacaatggtgaaatggagagaatttcttcttccttctgctaatgtcataatgcaagtaaattcgaaagcattgaaaggagactgaacacaaaatatgaataaactagaatagaacacctggagcaatcttaagttgtaattcctattaaaaatattttgccatgttaattcatctatgtctagagaaataactggagcattgaggaaaaaaagtaggagaggcatttctttcttttcatttataatttttatttctgattcagaagcctttattatctaataataaacagctaataaagtagcaaactacagcagacatgactctaaacaagaaggaatataaaaaccaaatagcagagctgcaaatcaaaatgattaaatataagaaatcatctagcaagactttccagagcccataaaaagggaaaatctgctcacatctagaaaagggaggcaggattataaataagaacaggcaaaagccaaactattgactaaattgcaagtaaacaaaaagaaacagtcactttatgatagaaatgtagaacatttggctaaatggaacaatgaatgcttcgttaaaaggaaatgttattaagtactttacatatagatgatcaattttcagaatttttctaacctcctgcagtctttctatatcagtaggtccccttcagtttctaagaatgttctcctcccttttgtaaaatgatttacaaggccaagttctgtattccattgtattctttttttttaattatactttaagttctagcgtacatgtgcacaacgtgcaggtttgttacacatgtatacatgcgcctatcttaactgagttagttctcaacattcagactggactcaacatcacaacatgggtgactggaataactccccttctccttacacttaagtttactatttctcctcaattaagaactgccaagaggtactgggatgaaagtagatttttccttcttttcagaaccatcttctccccaatacatgggtcccatacttgggaccaggatatacaggaactccaattgtcaaagggactaaggggtcctgaaggaaggtattatttcagcttattttgtgagctgcatggccaacagtatcttcactagaacatagtagagttggataattgtcttattcacacagtgctagaaaaactcacatcacaaggatgatttcctgcattatatgtgtaaaattcaacttctgaactgaatatatttctgtccatgctatcctcattgtctcaagaggggaaattgcctctcatctggtctcttgggtctgatttcatttatcctcaaaccattctccacagagcagctaaagttatttttaatgcaatctgattatggcacttggattattaaaatttaatgagttcattactttctatagaataaagtccaaataccttagatatattctcagactttcaccacctactttctctgaggcatctttcctgattttccaggcaaaatgtattgcacccaggactgtacccttcatatactgtgtacagttgtttgtttctctcactattctttatttctgccattctacaagttcctaatatctactcctttctctcacacttagcacgtaatgacatccaaataaactgttattagttcaatggattaatgagtgagtgagtgagtaaatgcacacacctgtctcggacaatggcttggttctgcatggaacttttggtcttttcatatttgtagttccacttggtgtaacagtggattgaaaaaaccactactcttaacattggaatatgtgaccttaaattctggtaccattttatacctcatgaatgttatattctttggcttctctgggcccattttccagtctatgaaatacagtttcttacagaagagttataagcatcaaatatgattaatgtatgcagaagcttctcaatagcttaggtaaatgtgtaaatatctaaggtaccactgttaattgttataaatatctatatgataatacaataatcaccactattgattattataaataggtaccactcttgattattctgttactacttaaaaactgataaattcctgtgatttataattactgtgatatgtaagattattattatcacatgtaaggtagcagaagtagccaagcctacttctctcagtagactgaataaatgtttatattattttaatgctaagataataaagaacagattgccctactcaccctggttggggctagagttggccatatgtgatacatacatgttggtgggaatgtaatatccatggatattactacatacatgttggtgggaatgtaatatccatggagccaggagtcaggtcagacaacaactcggcaactagcttcttgttatatacgctttttagtcacatatcctaaagtcatatcctaagtgaggatctcaacttggacttggaagatgacaataacttggaatcacctgtccttcaatagccaggaaagttggttcttgaattagggcttaaagaatcaaaatgatttggatagaatgaaatggaagctaaagggcattccagaccagaataactcttaaatgagtgagaccaatagaaaaaaacttaatgagaaatcgagcaaattagacgtgtgctgtgcttggtggcttcagcattcctttcttactttgtgtaactgatggcttttgttgtggaaacagtgtaacagatggagtcaatttgaacaaatcaaaatgagcaatgtagacaagacatagagtaagacgttaaaccttttatttcccttaactatcttttgttatttgtatttttctttttattttgtatgctatgaatcactaatgattctctagttttaattaataaacaattctaaatacatctgtcatttcaatgaacttaattaaatttccattggaagatttaataatatattttctgagtattaaatgatatcagatttttattttctcttcaatcattgttttgaaaacatattaccctgaaaaacacatacaaaagtgctgtattttaaaaatttactcttcttaacatatttttcctactagaagaggcaacatttactttcattatttaatatgaattcatgtactcatttatttaacactcattttaatcaagatatgcaaaggtgagtaaaatatgggctttgaggctagggtgtccacagctaggaaaatatatattatttaaataaagaggaaatttctgattaattctttgctttcttaacctgataccatggaatatttataaatactgaatattaagtaggaaactttgatttgcttaatattgagaaagtagcacaattagcaagttatctcttttgaattaaaaattacaactggattatagtttagtgatgaaaaatccaacaaaactaccatgtttctcttgactttcatttagttgtctgaaatgaatagtggccttgcttgtttatactgtaaacctagtagttaatttttaaggcacaagggctctgacttaattttctttgcttcattccactgataagaagaatgtctctgtgtcaaagtcattttatattttttattgtcattgtctcattctattatataagcagatattaattctaagtatatctttcttcttaagtagagttcagtcttgtttctgcctccactttgccatccattacatattttcttttggtattatctttgaaaattattcagaaaccattttagatatctattattctttttgttactgttttgagataaattataatgttaaatgttataattataagctttcatgtcaaacacattctttaaactttgcggatgctaatcattttcttttaaaattatgccacatgattattagtttcaaatttttagtttcaaaagcaacaagtttatatttttgtcttggattggattctctattttacaaattataaagttgtccacataatttagttgtctcctgtttgttgtatattgtaaaggatttatgccatagtataaaaataatgaattatggaagtgaattattttattatcctaatattgtgattttatcattcttcttcacttccactaaattctgagtaatgcctcaaatcccagtttaattaaatatatattgaagacctactactatttgccagaaaccataggagatgtagtaacagacacaatgcaagtataaaagacttcaaaatactatttgttttgggagcacacattctacaaagttattctacttgcacatagtgtacaacagaagacaaaattttatctgtgactgctttgcaaactcagaaggctgaggccttgcatagtcaagaagggctctgactgtaatctttgctcaagccaatttaaaagaagcattctgcattcaaaatacataattatccttaaacatttagttgatgatctgactctagaagaatagatagaatttggatatcttacatggttgaagaatttcataatgcattccaggcaagtaaatgaacatgagcccagaagcagatgggcacagtgtgattgcaagaacaagaaacccactgacaagagcaggattagcaaaagggcaggggacataattgataaaatagaagaaaagtataggggaagaggtattagaattagattatactgaaaagtgtaggtagaggggtgatatactaaactgatgtgtatgtaaaatctcatgggtgagtgtgacagactcacgggcaaaccagttcggaaggtatcccattaacccaggcatgttacaataacaacccagattgagatttggaaatgtggatataaaagagtgattaatgatgctgttttgattatttgttttcagaaataataaatcttggtaactatcttgacaaaaggaaggaagaagaaagatgaatcagagccattgtacatttttgagcctgggtgaacaaaaataatggtaatgacatgcatacaggcaagggcactgggaagtgagcttattaagagtctgggtatagatggagtgaaaggtaaggaaaaccaaacacaccaagttttcaaacttccatcttgggtatagttagagttaatgataaagtatattaaaaccagactcactttatttagacactttcattctctattttgatttgtggaagttttctacaatctctgttctctaagagcatcaatcagtatatttcatataaatagctattgttagtatcctttaagttatttattgctctaagtgattcatatatttaacttgtttaatgctcacaataccctatagagagttactaaattattattatacaattttatagatgagaacagggaagtacagaaaatcaaatagcttagcgaaggtaacaaagctaataggtcctgaaaacaatttttggaacccaagaatcttctgctcttatctactggtatgtagattgattccttcatgccaaatagtcggtttagtataaacaagtcacatcttctctacctcttttagctcttatatactcatttttttttttaatttaagttctgggatacatgtgcagaacatgcaggtttgttacataggtaaacatgtgccatggtagtttgctgcacccatcaacccatcatctaggttttaggccccacatgcgttaggtatttgccctaatgccctccctcccctttccccccacccaccaacaggccctggtgtgtgatgttcccctccctgtgtccatgtgttctcattgttcaactcccacttataagtgagaatatgtggtgtttggttcctgtgttagtttgctgaggatgatggtttccagcttcatccatgtccctgcaaaggacataaactcatccttttttatggttgcatagtattccatgtgtatatgtgccacattttctttatccagtctatcattagtgggcactgggttggttccaagtcttgcaatcataaatcatgctgcaataaacacgtgtgcatgtgtatttatagtagaatgatttataatcctttgggtatatacccagtaataagattgttgggcgaaatggtatttctggttctagatccttgaggaatcgccacactgtcttccacattggttgaactaatttacactcccaccaacaatgtaaaaacattcgtatttctccacatctttgccagcatctgttatttccggacattttaatggtcaccattctaactggcgtgagatggtatctcattatgaaccatcaaaataagcatagaagataaggacatttaaaatctggtgattatatgtatagctaactttatttcccaaaactcctcccaccaaatctgctctccaaacacggagactgtgtcatgttattttatgtctcttggcttttcacatattaattcaaccgaacagaaaattcccctggctaactagaaactgctaatcagcttttatgcttgtaaagcatactgtggttgtcaacaactgtctgggcctgattttgttttcatttgttttaaatctagacttttggagtcttgctgctatggcatgcctgtgcaattgagtgtactaaagaaattcaggagtgagacttttgcactgttttagtgtgtcctggcttaattatttttttatttttattttttggacaagccagaatgatctgctcatatcctacctcttatctgtcttttttttaggctgctttcttctttgtacttaaagctcttagtacctcctgcaaatccacctggcctcagagtgctttatagttccttagttgcttccccttatcaaaatgttcatgtctctgattttgagaactgtaacataacaataagttatgttaataagataaacaaatccctgctcctgagtaaatgagataatgtgctatttcttatagtttgatcatttctgcttaactctgaaatgccgtgctcattgaagaggcctttggaaagttataatgataccagaaatagtcattttggtctactgcaaggtaacttttgatggggacattactacaagtagacaagtaacactctgtttttgataaagagggcttaaaaatcaagtaaaggaaacaaatttatatggggtataaaaatttgttatgatgaaaatacattgaataaaatgataaaaaataagtacatagaactgttagctaaatgtaatcatttttttcagattccctcccctgccccagaatatcctgtatacagatccagttattttttaaaaatcttttcaggtatctttattttagtatttaacagctcaaaataccacaaggtaaatggaatagacatccattctcttgttttacttatgttgaatacagtttatagaaaaggcaatattttattaattttaaaggaccataattttcctgcttcatggtacgtatctgtttgctcttagacaagttcctaggaacaacaattttatgtttgctccaggtacacaacatctataatataaatataaagctgcatttaagctgacattcagtcatcaaatttcctcattttaaaaggctaaatcacacattcaaacaatgtgcatttctgagaaaaaaaaattgtgtaggtatggcaaaatttttttgtgtcaattaaataccaatggtgttcaaaatgtctccaacatgcatatcaaaaggaaattgtgttaattatactgattaaccctagtttattatgtttcaccaagtaagtcctcctagaaaggaattagtggaagatgcataaacattttaaattcaaatgcagagtgtggtaaattgttaccacagagacttaaatggattattttatgttctcagagcatccatcaggaaaaaaactgttttagaaaaccaatgtgattgtgtcaagatgatgggactaaattgaccatggcaaggtttagtcagtgtttttcctgttttcattattgattgcataacattgattatgttaactgtgcagagctccaatttacttattacgtttgctaaaataacagattggcattggcacaatttctttttatttgaggtttttaggtacattctacttgtcattattttgggagagttttttttttttttttttaagaaacctagaattcctcttccccatcttaaattctagggtttttttttaactttttatttactaatttcattgcttgggaatttagaaaaacccagtcattgatatcctctgattaagtaccttatttcctaagaaaaaaaaggaatagcatagggcgtattgtcttttctataaacagtattcagcataagtgaaacaagagaacaaatgtctattccatttaccttgtggtattttgagctgtcaaatactaaaataagtaatgatatctgaaaatatttaaaaaaataacaaatcattaggatagattcaacataaaaagcagaaacaaaaaacgttatggcttctttctgtgatgcagttccatattttatactattttaaatatgtatgtatgtatatacatacacatatatatgtatctatatatctctgatcattgaaaataaaacaaggttctgagaacatcctcattaaaaaaagattaaactattaatcagggatagtgagtacctattaactgaagatgccattttgggaaagaaggcatagcccatgatctagggtttcttgcttcaagctgctactcggaaatacccaaactttggataaaagaagttttgacaaattttaaggacgtaaaaccagataagtatcattagtcactaatgagaagattatgaggataaatgcaaaggcctgggttttccaggagtgtgtatgcagtgacttaacattatcaaaaatgggcaagtgagcttccctggcataaatggataagaaagcaaaagtctaacagggacctcacctctaccatgtatgaccatgtatgaccatgaggacattagcaccagactgtcagggtgccagagtggctcctgcatgtactagttctggaacttgggcaaattacttaatcattgtgcctcaattgcctcatttacagagtagtgataatataacaccgatctcatagggctgtcataaatgtcaaatgagtaaatgcatgctaagtacttatagcagtgccatacaagcagtagctgtaattattacatttgtgtttcttttatatttgggttaatggctcccttatagtgagggtgggtatacaagaaagagtgacaagactaaaggtttaaaagaaatggcagaaccagacagcaggctggttttttttttgttttgttttgttttgttttgttttttttgccggagtctccctctgtcgcccaggctggagctcagtggcgcgatctcgactcactgcaagctccgcctccggggttctcgtcattctcctgcctcagcctcccgagtagctaggactcccggctaattttttgtacttttagtagagacggggtttcaccgtattagccaggatggtctcgatctcctgacctcgtgatccgcccgcctcggcctcccaaaagtgctgggattacaggcgtgagccactgcgctcggccggaggctggtgtttttttaaggttaatcatcaatttattctatgttagcaatgcactcattttcaaaacaatatttttctatttatgtatctatcttccttttaaacagtacacatttaagttttatataaggaataaattcattttatttgtttttctctgctattgacagttttgttttttttttaatcttgtgctggactcctgcaggaaaactaacataaatccatccatcaacagtatttgaaacaattaaaaattatattgtttaaaattaaatctgtttaaaatagatgtctgatatttgtacatcataggaatttaaaattatttcaagaacaatggtagccaggaatactcttatagcacatcaaagcatagtttctcatggcataagtctgagctattttagccccttatcagcaatgcaagttcttaacgaactgatagtttttagatgagcttaacttccttcctcttgccaaatatgttgttgccatagctatctcctttacagcagtgatgttattttattagcatgagcttaaaaaattcagttatttctgtctgtcaagacacaacatacacattctctcaaaatttgcaattttctttttttacatgctttacttaatttaatagtcaatatgaaatcgttttacaaagtaagccagtttcttcacatatctatggaaacatttggcagttaaattctcctggcaggtacactagccagttcaaagacagagagtccttgggatgtattttctattgctgaggaagctggcttgatttgaaggaaaaaaaaatccaagtcaaatcatcctttcagagttttatgttataaaattctgggggatctgaatcaaaggttacttattcttaggtaaatgtgatgatgctttttgagaaaaatcttgtttttaagcttttttaaaactgcttccgtggaattaaagtgttctggtgattgttaacgataatttctcaggaagggtttcatgggtttataggtaactcccctaggcaggtatctgagatcaaatctacagattcagctccctaactcttgtaatgcagtgtccaaactgatagtttggctacccaaacatttgtcctgaaacagcagcatggggcactaatgccagaaagtcccacaaccaagagaatggccttgactccgaaccatcaaaaactcagtaatatttaagagaggaagttgagggctgataaggtttggctctgtgtccacacctaaatatcatcaaattgtaatccctacatatcaggggaggggcctggtgggaggtaattggaccctgggggaggatttctcccttgctgtactcatgatagtcagtgagttctcacaagatctgatggtttaaaagtgtgtggcacatcccccttggctctctctctctcctgctccaccacggtaagatgtgacttgcttcaccttcaccttccacaatgattgtatgtttcctgagggctcccagtgatgcttctgtacagcctgtggatctgtgagtcaactaaacctattttcttcataaattacacagtctcaagtagttccctataacagtgtgagaggagactaaaagaagggccttgacatccatcccttcctcctgatacattgagttctagccttatagctgattagatctctgaaatggtacattcttgaaattcattatctcagccctcagaatgatcatcatccttgcttttataattattccctcaagttttagaggacttttataaaattaggatatttgaaaatcaccctaacattttaggaaaacttaccaatgacacttctgttatgatgatgaatggcccaaatataagaacccatctgacaatgttttgctagaatttagcatgaagaaaaaatacttttgttgaagagtcactgctcattctttgttcatttatttatcaaagaaatattggccgactaccatgggggccagagtctgttctggatgctggacattcactactgctgtcagaaaactcactgtcaagtcacagaaagatataggaaaagctgacgctatgaggagccagggaagactggagactcaggaagaagtctatagcaagaagtggcatttggcaaggtgtttcatcataagtaaatatttgtatgtagaagaacaggaaagggccttagggacagatattagagctttggcaacagcacagatgtgaaaagtaaacagtgagaaaagttatgtgcagttgagagagagaagttccatgtggctagtaagaaacactagcaggagctgaggttgaaaaggatctctcagggtaggtcgtaaaaaacttgggatgctaagctccacagtaagttttactctgtggatgaggaagggtccataatgaacttaaatttaaggcgaacaacatggtcagatttatgagatgaactgtttgtgaattttataatggaatagactgttattgtgctttgaaaattcctgtattaccaggatgtagaacagattcaaacaaatagcatatgcttaattactatctgttgagtcgaatgcttagttatgaggctgcaagagtctaagggtagagatacagaataatgttggagttcagatatattttaccattgattcctcttttggatattgacattcccataactttttccttttcctgaaggctaggcaattcagagctatgcaataattatatgtgttcctcacagttggcatgcatgcttcttcctttttgtggcttttattttctgtttccattatattgatgttaactcttttgtagcttttatcataggccacctcaaatatgttttggaaatatgttgagtgtaaatgaacccatatttatttggaaacttttaggttaacactgctttcgtatttcaggcctattcacatggaaatgaccttaaaagatgctcacagccaccggctcaccctcaatgatgcgccccctagaggaggcctgcagcccactcaggcaggctgccagtcttattttggaagacggcaatggcaaaatgcattctccttgttatgtccacttgtctttttatttttttgtggtttcagaaatatacaagcattgagttgtcatgtacagggaaattgtctaaatgcagctttaaaaaaatgatatacatatcaattaaactctttaaccttctgggatttcttcccaactttaagaatctaaatattaaaggtaatctatggacaattcagtctgcaccatgaactataatcacataaaaacttcaattatcaacacttatgatctgaacttgctttttggtacaatagaaataataataacctaaagtgttatttggcattgttgaaggcacctcagtatgctgatatgcttgagaatcacagctatgcaggagcctacggcaggttgaaataagtgacagctttgaaatcaggaaatgtggtcctttcaacatcaccttcgcacctcattcacagtataattgggaaagtcatgcaatctcctgaaaatcttacttcctcatctgttagacagaaattattctttcatagaattatgaaaattgaaaaaatgtgtataaaagtatcccaatacagtatactgtataaaattgtattttaaaactgatgtaagtgaattatagaaattctggttatgggacattgcatttaacatagtcagtaaatttactgtaaaattaatattttcattatgaaagagacatatattttaccactctatgcccactattcatctatcctgaattaaacttggctgaaaaagttaaatttaaaaaaaagtttggtttgaagagcaagtatttcctaaatgtgatagcttaatgataacactgagttagttctaatctaacattaaaggaagaaacatgtacacttacgctttggatgggacaaatttttgttattcacatttgaaattcactttagttttagcacaataaaatttaataatttattagtccctcatagcactctgctgagaagtgaatgtcttgtcaaaggatcagttcaaagtagctttacttcctacgtttaactaatttaaaactgccttacctaggccgggcatggtggcccacgcatgcaatcccagcacgttgggaggccgaggcaggcgtatcacgaggtcaggagatggagaccatcctggctaacacggtgaaaccccgtctctactaaaaatacaaattagtcggctgtggtggcaagcggctgtagtcccagctactggggaggctgaggcaggaaaatggcgggaacccgggaggcggagcttgtagtgagctaagatcgcgccgctgcactccaacctgggcgataaagcgaggctgtgtcttaaaaaaaaaaaaaaaaactgacttacctaataaatactaaagtagtcctccctccagtttcagttttttttttttttttgagatggagtctcgctctggaatatgaaaaatctttagaattttataaaaatctgatactgcaaatattattacaaaaagttcaattaaattaaacatttttgtggtaacatggtactgacaaccatcatcttgttatcaaaatatatttgaaaataaatcaacctctaaaggattttttaatagtagaaataatataaattttttttattgttatactttaaattctagggtacatgtgcacaacttcatgtcctttgtagggacatggatgaagctggaaaccaacattctcagcaaactattgcaaggatataaaattgttgtttaagcagactacctgtttaaaagaggatgagagaagaaaatgaagtcttcatggctctgttatataatcagggtgaagcaataatttaaataactcaacaacatttataaaaactcaggtagttttaaaaattgtccattccctatatatgcataatgtaacatagaaggggctattcatcatataaggcatcttttgaaagctgaagagggaatgaagtgcatttttatttcaaatgacaaccataataagagactgcatcatattgttgttttttaaatgaatacaacttggttcctagatatataataagaatcaactgggtaaagctagaactaaacaattttaaaggcataagaatctctcaagtcgggaaaaacaaatatttggaaacttggagggaggaagagatcccactctttcttcatccccacatttatttaaaaattccactggttaattctctaaggaattctcttagggtttggcttccatgacaataagctctctttgtttagttttagtttctttcaaaaaatgacaagctaataccacagataaagaggtcagaaagaatggactcacaggcaagtacactttttaagtaaagtgacaaagcaataccaagggctttgacacttgagacggttcctgagtggaacgacaaggtgttctgtaattttactgaagttgatgagattatgctttctactactttggtagtttgggtgtctgacattgtgaatgtttgcatattttcacgttagcagagatacaagtattaggaaacaatgaaactggaatataataacaatcaagtgttctattgcctcttctaaaacatttgtttaaatgaagaaagtagcaggcatgtggccaaaaaactatacatgtatacactaaagaaatgttccaacaaataagaaaattggtcttgttgctttcagttattctgtgttgatcaaaacggggaaataatgtccgtttaaagctaaataaaatataaattccaaataaagccatgcagagtaactcaaacagtatttccctagggtcaagaattatgggttcttttcacaatgttaaatatgcagttgtttgtattctgggtctgtttctccaaccttaaaatgaattgtttaagaacgagctctaatttttcttcaagccctaagatcatatgactaaggagaaatgatatccgcatgcctggcatgagttctgcttttctaagtatttattattattattattattattattattattattattattgggcttggactcaagtgcctgttgcatttgttatcttaggcttatagtggttttcaatcttgttggtctcaggactctcctatgctcttaaaaattattgaggactccgaagagctttggtttatgtgaattacattacagtacattaaagcttaagtgatcaccaatgttaagtatcacttgccagttgctacctaagctctccagtaacctttggtctcatcagttttagcatgattcaaactgatcttcgaagaaagggagctaatttccttactgtatcattaggttaaagactgtgacttcagctgcttatgtttatgcttttagccagatctagtatctttctctgggttattctttaggcaggtttttgctaacttcgttaaacagatcaacaaaatattatttctcctgtgtctactatgtaaattatctctacctcctcttactaaaagaggatggaactttttgttcacatattttgaaagaagaaaaatgttagttttaaattttaattttaaattacaaaaattacaattttacaaacacagagctgtgacaagtccctattttaatacttttaaaaggcattatagttattccttcatctttaaattttatatttaaaaatgttttccaggctgtgtaaagtttgaaggcactgtatttgctgaaacagtcaaattttatcttggcagtaattgcttctttacgacttgtctgcctgacagtgtagtagatgatctcttgatatgtagtctgaggttgcagactcctaaagctgtctgtggctactcacagaattcctcgcacctactccaccactgcttctgtgaaattatatgttccttaaagtgtgtcatgtaattgtccttagttcttcctttgctcatggtctttgtgagaacaaacttcaaatgtattcaatggaattgatgtggctaggaaaatgtatagactgccgtcattgctacattaaaataataatcaatttcaattctacggggtacacattaatggatatggtttggtgtgcggtaatttccctgtagtgaaagagtatttttctattatgtatatcaaggggcctgagtctttcttaggagcaactctctatcatacaaaataatcatgaacagatggcttttgttctgttttagaatggcaacaattatgtgtgtgatattttcaatagcgtgcagtatagaaaggaaaagaaaaatataattgcaaacttttgttagtgctacttttggagcaatataggcaagaactaagccaattcatgaagatggttgtatgttaattcctctctcccacacaaattttagtgagggcattatttcttacaataaatattgggaatcaatctctttcatattgattttattattttgttctcccaaatgccataatgcatattcaaatctactcagtaggcaatttagtctagcagcaaatggttgcatattggtagtgataatttaaaggctgctttaagaaaaagtggagaagacaaactcaaattatttagatctaaaaaaacacaaaaggtagaatatcataaaatgatacaacatctgaatgaaatttcatggacaggctatttttggtgtaaatgttcataattaattttcagcagctatattgcttttggaaataatgaatatgtactttatcatgaatatttatgaagtgatatgaaagattaaaattattagcaaaaatgttgaaaatatttttaattccttttttctaaaaacttttaatactatcgcacattgtttttttaatgtcatgctaaaaattttgtttcttatatgatatatgcagctctttaaaattgtaagaaattattcatgaatgcatttaacttctgccttaagaagataaaggtacgtcaagagattgtacaatacttaaaaatgcagactttattaaaaacacaactatctctaaaaaatcaaaaatacctctgtataaaacgtgatttaaaggttgactattagtgcgctgcacaaaaaatgaattgctgtaaattgttttaaaatcataaattatatttaaaatttaaatatgtacacttgcataatcccaaaatattggtcaactacttggtaaaatcaggtggaaaattaatcagattttcaatttttccttagtcatgtagttagagaatctgtgcatctctcacatatgtgttagcggaaagaaaccagtaaagattatctctagaatatgttagaacctgcactgtttctctccggcaatgcctgagacaattccacggagttgatagtctttgtatcccaacagccacttggcttcccacctggggccacgcttaagagatccagaccccatccttccttgggtggagcttcagcttcatctgttctgtccttctctcctcctatgccctttcctaattctgaatagcaaagatgggagaaattggtggttgatttcaaagatctgaactatattatatagtaggcaaagatttctttataaataaaaaaaatcactaaaatcaatgataattgtttatataacactatttgcttcatccagttaaggttgcagtgtagttgaccctgaagagaaggccaccacaactctctctctacatatatatatatcatatatatatatgatatatatatcatatgtatcatatatatgatatatatgtttatatttacatttatataagttgaatatatgatccaaatggaggaattcttcatattaaaaatagtttgtttgcttccttacttatctgttaatatgtcccttaggaggaaatcgcaagatgatttaggacaaagagcagtatacaatcaaaaagatctgggaaataaactgtgttcttgaggcttcaatttaatgcatttagtgtggtacctaataaatgaatatccattatgatactatcactgtgtggtttggccacatttatgttgtgccactgagtagagatggaaggatgtacgcaactctgcatcccagtgactccagaacacgaacactgctttagttagtctccctgactttgctccttctgtacatcctctcagagatagggtgttttctgagagaacaaagaaaggcatataccgtggatggctgctattcctgcctatccagtgtctatttctccttttctcttaaaaacatctgaattttgtttgtgtgatttagccattagatactaaattttgggggggggtgttaaaatgtgtcacttctcctgaacttagttttgaaaatcagatgctagcttcctaaaatgtgcatctttaggtaaagaacatataaattaagaaatatttggaagagactcatgggaatggcagtatctgaagagaccatcaatagttcctgctaattgttctcaacttttctataccttgtcctttctgaaacctcttcagctttttccctcaatatccttctgataaatactccttttaattatatgtgcatgtgtatatatacacatttatgcacacatacatacatgcatatatacacacatatacacatacatatgtgtgtacatgtgatatgtttgtacatttaataaattacccagagttgggttccactggttaatgaagacctgtatttataataaaattctgaagagttagaatatatttcattatgtaggagaagcgtcactgcaaagcatcaccaacaaatcatgttgaaagagacaggaggagatgtggaaagaatagtaccagccaaaatacgcaatctatttcataggtaggcaataaatactgcagtagggttaagcaaaattaggctgaggaaagagcacttattttgacaatgaagacggtaatcatcagagaaaatcctgtaccctgatggcccaggggaagggggagggggccatctatactgccatggattaaggtgaggaaggaagaggttaataaagagagaagagaaaatcagccttgggaaagagagttgaagattacaatatgattaatctgtgttatttgaggaaagtgggaaaaaaaggcaaagaaagaaatgaaagatttgacacctcataataggaagaataaataataaaagagattaaaagagaagaaaacaaagcacaggtgattttcctagaggaaatagtaaacacagaagtaaggaaatgcaaagagcttaaatttacagcctgtacaattttttagaacacaatggtttttagtgttcagcattttccaaagtcaggcataagatgattctaaaaaagcaataaaacactctgttttatgtactctccatctttatacttgcacattgttttatttttaatttttttctgaaaaataaagagagtttgaaaaagcaatgaatatataattcctagtactgtgttgcattgattttacttaaaggaaaaaaaaaagaaacttaagtaggattgacccaagtatccaaacatagtacattttttctacttatacttctatataaacagtttgatacagatttgcgatcaggttcttataaatctaaaattgatcaggtaattcaatttaatttaattataaaatagctaggtagacattttcataatagataattaaaaattcataaaagagtacataattgaattaaaaatggattagctatatttgagatgctgtgtcctatactcacaaaatttataaattggcaaaagtgtcattgttaaacgtactgtttttcttttatcaaaaaaccctgttgctgttcattggacagtttacttttatactttaaactgacattctatgaaaaaatatgaaatgataaactagtatgttaagcagagagaaaagtattaatttacttttgaattctgagacctataaacttgtagtatctattaactgcatgagatcttgaacaggaaatagaaaatattttactgtccctacaacaaatgattaagtgctaaatgggtaatggataatgggcagctaatggataacactaagaaaattcctcatgccaaggcaagaaagaacgactttaaatcatcaggaacatttgaagtatcaatatttatagaatttttacaggaacaattaagagagatatagagtgcaaaatgtgagtaaatgtattaactcagtgaatattataattagtgtaaaattttggtgtgcctggactggaggaaaacaattttgattaacatgaagaaaaattataattgtcaatggcggcccaatcttgtggaactttagatctaatgagaaagactatagatttcattctatctttgtaaaagaggaagaattaagatcttagaacagaaagcagtatgaccactgctgtactatggaaagaacattcttacaagaaagtgtagcatgaatggaccagaggcagtgaggtcaaggagggggtcaataatgtagaaataattacgatgccttttaatatatccttcattgaatcattcttcatctgcattgatatcacactatgtctctgattagacatagtgtgtctaatgagaatggctcattgtctgagctcccctattgattgtgatcttctctccggccaggacataatttatgtaattatgatttatgattatgtgccctagacctacctcaggtaaaggttaattaaatatgtaaaaccaagtgtgagtgaatatcaagatgtcagaagatagaaatcattaggatattagttatcagtgtaggataatgaatttcagtgctaattaggaattgcaggagaaaacaataacagacagattgaaaattaggagactacatggttccatcgatcttaaaagaacaaacacttgccttttatttattcaggacagccgggccatggccttgtgacctaagcatggtcatttgaataatccagcagaagactttatattttaatggaacactacaaaggcataaggtttgagaaattattaatagcaactacaatgtccacctgtgtccagctgttataaggggagtaatgacatccccagttaattttctcttgtcaaagttttgcctttatctgggtattcttgaaaaaaacagattcttcaggactcctcctgtgagcagtattctgtgagcaactgtttaccaagtcaggttcaacctaaccctgtctaatatagcatcataattgtcaaaggaagggctacagagagaggagaatttgaaattcaaactccggatatgttgacagcattaaagaggtgggaggaccagaaaagtagaaaagggaacaaagatgagtaagaaaagcataagggtggaaatttttattcacaaaagcaaagcagtatcaaaaattttgccttgcacattataaacgtgtaagactcttctgtcttataattatatttatgcaatttttctctattgtcataatttttttgttgaatttattttccacacaggtctatagaatttatagctcaactgtgacttccactgttgattttctactagtagttcagttacttgtaccttgaaaataaaatttgatagcaaatttgtgtaaactagtgattagtgagcataatgtattttgactgtacattttgtaataatataggcaaaatacactattttttacattttatatggattaagaataattttatgcttctcaattgattagtaaaatataaccttactttctgtaagaataagaaaatatcttgactaagcctacagatttatttgtaaaagtaagtaaaagggaaggttttaagtatcataatgattatgtatttaatttgtaaatatctatttaattttaagtaagttatttattttttcttattttttgctaaaaaaattgttatggacacctgtcattaaatgttagtactattaaaaccttatgatctcaatttttctattttagtcattttggtattttcaaatggaaatagaccctaatttatgtgattatcaagtggcaaaaagtttaaaagttgatattaatatattgatcaatttttattggtatgtacatgttgcatgagatacatatatatatttgtatatgtgtacctacaaatgtcattatgtttgtgacaaaatctttaggcaatgctgataatgttaattactaaatttccacttaatataattttttaaagaaattaatacatttttaaaatgaaggcataaaataatcctgttgttatttaaataaaaaaaaaccttaactctggctgtaactatgctttatggcaatacccaaatatcttgagaacagcaatattgaaagttttatatgctaataagaatgtaatttacatttatagccgaactttaagtaattcccatataattttattgtatattaactaggttttcccattcatatatgtgcattaaattccagcttttaaaagtcacctaagatgtaattaatttataataattacatcaaacattctgaatttatactttccatgttgctaaatgaatctctaaacattaaatcaagtattgaagatcaaagacaactcatggacacatagagggggaacaacacacactggaccttttttggagggtggaaggtgagaggagggagagaaccaggaaaaagtaactaacagataccaggcttaatacctgtaggatgaaataatctctacaaaaaacagctatgggggaacaacacacactggaccttttttggagagtggaaggtggaaggagggagaggaccaggaaaagtaactaatgggtaccaggcttaatacctggaggatgaaataatctctacaaaaaacagctatgacacaagtttacccgtgtaacaaatctgcacctgtacccctgaacttaaaataaaagttaaataaatttttcaaaataatattttttttaaatcacaaaattgattgagctgtctacctacaaacagaactgtgtaatgggtaaacaaataatgaatcatcttaaaattacatacttcacttgaagttgagtctgaagttgagtcagtcctagaatggcagacctccacagtcctaaacccttttctctgcacagttacagtcctagattctgttacagtagagcactgagggaaataaacatcttcacatttgtacttggttaaatggaattaaaatggtttcatagatgtttagtctaataaaatttgtttttttctatgaactatttaatttcattaattttatattttactttgatatcagatctagctccaaagtaatgtagaaaaacgtttttaatttaattgtagaaaaaatatagggttaaatatcaaaacttatttggaactctatacaaaacatattatataaatatatgtaattgcattatcaatttatgttgatggcaaagtcatgctttgttaaagatatctcttaatactagcacagcataaatatctgtgaaaagaatactctttcaggtttattggagaaacgttaaaaatattcactttttcatttataagattatatactgtcatatcttgaaagtcattaatttggagttatcctggtctaagtaatatagtacaagaatagtttttctgggtttagtaatgagcagatagggccaaataattatgaatagaacctcacaaattagatacccaaaataaggcacccagatttctagtgagtaccagaacaaagatgtctgtgttggcacagaggcagacagcttgagggatgtctaactgtacactgtaggataatttgccaggagagaattttgggaagattttggtaaataagcaataggcagtgggtagtaaagccatacctgtgggaagtaaaaatgtatggcaataactgggtagggtagaaaataaaaaatggtttggcagtaattgaaacttcagtaaccaaactacaagcatatcaatcagcacaattttccagttggtaaaaaagattaaaaacatcaagagttgttggagaacaagcggacaagagcctaggtagcagaacaagggcaaagtggagagctcagttaggaatgcttccttccatttatcttgccaagggaaaggatcttcatgttcatgtgaggcatgtgaaagcctctgattaattacttctcatattgaaacttaaagggctctcagaatagaaaataaaaaaattacttttactagtatactctagcacacatgttcttctaataatagaactgtacatgtacacattattggagcacctcaaaacttccccagaaaagtatctacaagccaactcatattaaatctttgtttctttttacgtggcaaacatgaaaataacttacttggcaaagcacatttagccctttgctcttttccagctgatgttgcctatgtttcattcaggtgtcctccaaaggttacttgccttttctttgtaatctagccatttcattaacagaagcaaagatgcaaaagtgccctacaaggctggcctcatttcaaacgtttacatgctatttacaatctcccatatgtgctggaaagctgatgtttaacagcttaaaaacattatccaaatttttgatgctgtcagtgtaacaaagtgacaaattcctaaagaaattattaaacctctctctcattctctatgcagtctaagaaatagacccaattgattttggatgtaaaaaacaaaaacaaaacataacaccttacctgctaataaaaccttcagactagttcagactccttctgtacccttttatcctatggctggtctccgtcatgtaatctagcccgggctggatcttagtggatgctgctcatgacattttctgctttctcatgcatactctgagtctatgtctgatttcataccgtaagttgaaatgtatggtatgtatatgtactgctgaagaactctcttgtaagctaagtttccccctttaccatataattataaacaaagtatattttatccttaaaaatagtctttagttgataatcacatttaaatgtgacctaaagtcgctattgacccgacgggaatgatatggtttggctgcgtccccaccgaaatctcatcttgaattgtagctcccataatctccgtgtgtcatgggaggaaagaagtagagataattgaatcatgtgagcagtttcccccatcctgttcttgtgatagtaaactctaatgagctctgacgggtttataaggggccccccccttctcagggaactcattcttcgccttgctgctgccatgtgaagaaagacgtgtttgcttccctttttgccataattgtaagtttcctgaggcctccccaggcatgctgaactgtgaatcaattaaacctctttcctttataaatcacccagtctccagtatgtcttttttagcagtgtgagaacggactactacagggaataagaacaaattttactgtggagaaaataaaaccagaagcagctagagaactgaagcacatgtactttagttattaaatcctgaatgcagagcctccaggaaggttgctgtggaagaggctatgatactgggtaggtgtttgagtgagcaatagtagtagtaggacaaggctaaggaaaatgctctcatcctccaggagatgagaaagagtggctcacctttagaagagtagaaaagaccaggagaacggcacctgcgagggattatgagtggccaacatccatcaataaaatgctttgacatgagtggtgctgggagtttcttgaggaaaaaaaggacaggggactttagattgttttgtgtaagtcgttgtaagtctttgatatagagatttgcctgctcctaatttgaggatacacaaaacacgcagaagcataaatgttgaatgaagaggagaaaacacattttcctcggtaaagagataaagaggaaagaaatcctagtgggcttttaaatgcctttatgtgtacctgtgactttgtgtacctcacttttagctgagatgcctcaaaatagctgtcaattatctttaaaaaacagaggaaggcactcaatgacttttgaaggctttggaaaaacggtggctataaacaagttttgtgccccttgtccacccaccaattggaggatgtgaaaaggttaacatcagagagaccacaggagtttgaaacttgaagaatatctttagagagtattgtctgtgttctgtgagtaccttaaactatggaagagggatagtgttccatccccatagcaaaccaaactggggaggaagggatgtcaaaaaaccattcactgtgtttcctgtatctgttggaatttttataaaagggtggataaatgtctaactcacatctagaaatataaagggtaagaaacagtgactgaaactactaccatatgcaaaatgaaaagagggttgaatttagcaagaaaccgtacttctaccagaagcatggtccaacattatgtgattcttctggacccaataggaaactctaaaacagagagaaaggaggagaaacaggtttgtgctgtcctagatcctggctaagaggttcactggttcacttgcagggttaatgagaccctatcaaagagtttctgtaaacttctgtgtggaggttgtcagctggctagggtgttctcaacccattttgagaactgctggtgagactcactaatggaggagggaatgttccttaagaaaccacaaaaatgctcctatgagtcagctttgtctcatcacaaatgagtcagaaacacactttagagttatgtctgtaaagtaagactttttttctgtcatattaattgtttttctactattaccaactatagaagggccagagatcaggtaacactaggtaaacaaaaataaaataatccagccaagcattttttcccattatagacttcttctctgtagggggcctgagctacagaagggggaacttgattttgagtggggtttgcattttgattataatattgagttgtatataaatattaatgaattaatactgtagaggataaatttacttcagaacatttttatgacttgagaatgacaaaaaaaaattctgtttcattctagtgggtgagagactggatatgcacattgagtcaggagaaaagatttagtacaacattttaaaatttttttccctgaaatttttacttgtccagtgaaccacttagctttgctacggggtactgtaaacttcatagcacatacaaaattatttacttcaatatcatttcttggaacttaaaactctcagaactctggtgtatcagttaggatttgatcaggaaaagagaagccacgaggtaagaaagagtccaatcccagaaattatgggtattaaaagaaaaactttaacaaattaacttagccaagttatttgagcagagatacaattcatgaatcagaaagttccctaaaccattaaaggatcagagaccctcatccagcaatgcggacaggcaatatttattgacagaaaacgaagtgacatacaggaatagcctgattagttacagctcaacatttgccttatctgaacatgtctgagtagttttcagcctgtgactgacttaaagctaagttgctatggttggcctagactttgttacttgttacaagaatacactctcaagttgcagtttgcttacatattaggttaggttacagtttgctatgtacagaggcagatttaagccaaatttaatttagtttatcagaaaaattgaatgtcatggaagtgatggagaagtgaaagtcaggtatctcagctgcatctggtgggtttcaaaagcttgcccagaagtcactgggaattttttgactcatgaggggctaccacagattatttcagtctgcaacaccaacagaagtaattcttaagaagcaccatcttgctatctcagctacttagagtactaaagtggatgattcaaggagcttgcccatagatatgcttgaagctgcaagaattacggctgctccttctattctgccttccaaactgcacaagtgcctcattgacagactctaacacagaactacaaagggcagaaaactcaaagaaaggttcttcttgaaaagggtgacaatgattccaagttcccaaccaataatgcagcacatctaatttggcacttcttattttgtcccttttcccttatgactttttttgtagtaacatattttactattttactgctattatgttgctcttgaagtcaggagtcatagtgattcaatcacttgttcacttatccatgcagcatataatgagagctttgactatttttcagtctctcaggctctgagcacaaggagtgataagatgcaactacccagaagtatagtcgtatcattcacacttatttgcaatgagaaacagtcaagtgtttactgagagtccatgaatgaataaacatataaatacacatttttcatatgtggacagtaagcagtcctttatctctaggacaacagaatgttgtatctaaaggaagactttaagaagatatttgaagacgaggtgctgccattgatgtgttaaatgtacaaactaaaaaattgggaacataaattgaagtatgcggtgcttttcttgtgctacacaaaaacgagtgttcaatttcagttggtaatgcttattatatgaagttttgaaacatagtttcattttatgtattttttagggcagatatcaccatatatcacacatagaagcatatatgaaacatgcttatcactcagggaattatgaattgaataagccataccaagttcttaccacctctaactagtgttagaatgtagaaaagaacataaactgagacttaaaggggcagtggagtggggtgggaagaaattctcaaagtccaacctgcatccagagtaagtaagtttgttagatgaagggaatcctaggtggtgttcgaagacaaattgaatgtatctgtatggtcttttgtgaaaccagtttgataaacaatttcctgataatcccaaggcctcctgaaatctctcaagcatatgaaattggggaatccgggggcaagactgagcaggaggtgtatggcccccagtaatagctctcatctacattatgtagctctgactgactctgagctgaattactgttttcttcacatattcaggtctttttgttttcaaatatactcgatcgctgaaggttaaaaatgtaaagcacaatttgtaaataaaacagatgtcaaaggaaagtacaaaatatcattaagtgtatctgaatgccaagttctccaggtgacagcaatgtgaagtgcacagttaaagatgaaaagaaaatagctcagttatttgggtgatcaaaagaatatctggatgattaattacatatttgaaacttgaagacatttcttttgtttcattttcttttgtcttttcaaaagaaaaaaatgtcaagggttgatatgtcattttagttaaggtttatgagctgttttttttttccccctacaggtgaaatcattaacagttttagcatttaaacagagctatttgagcttacaactaaatcctcttggcatgaaagctcttgttttgctactcatggttttagtcttcctagaagctgattgattaaaaccaatgtgctcagagaattcaaaataagaaagaatacaagtaagaataacttttgacaatgtaggctaagtcagccagtttgtttcatttatgtcgcctttcttcttcacactttttacctgattaaatcccattttcactttgtgtttatttgtttcaatttgattagagtttctgaaatgaatacttagattcaaataactatccataaagccatgtgactgtaggattttaattcatatattagtactcgcatacacaattattaacaaatcaggaaatttctacatttcccttgaagcaagatactgtatatttagtaaaattccttgataaatacttggaatggaagacacaacacccatgtggtaaaagttttctggttccaaggttttagcaaggaggacataaactattctgtgtaaaaagaggaggatgaaaatttgtttgcttcttgagagaggaatgggtgtgataaaagataataaagaaagaaaggactcaggaaaatgaagagatgatttgaataggccaagtggaactccctgaatgatgaatatccaaaattcagatttagaatggtggtaagattcttctacttgatatttgtcatgttcaatcaaagcacttcctccttcctccctcccatctgaaatctttagaaaaaccatccatttaaaaagtttagccaaaatactgaaattgaaattttatctatataaataagagattttgatgattgaataattgtttggttatttctccttttagtatttataacttctgattttccagtctatggttttacattttgtatttttgtactttttacttatcatccaggaaacatgctgaaataaatatggagctaaagatcacacatattaacagcttaactctctgagatatcaccataaccaatgctaataacttatcttctttcaatttgtagataagaaatacatgcttttgtccatatacacacagaacaaatattctttgatatatagatatatttttttgccatgatgatcttaatttttacatataaaatgtttgtaaaataattccacatgtttgaactcagctataaatttaaaatccattcaaagttaaaaactttaagataaaaattaaaatgtcttataaatttgtttaaattccttatagatgctggatatgataactttgacaggggcatagtttgcaaatattttctttctgtaggttgtctatttcctctgtagatagtttcttttgctgtgcgtaagctcttaagtttaattagatcccatttgtcaatttttgcatttgttgcaattgcacttggcatctttgtcatgaaatctttgtctgttcctatgtccagaatagtattgcctaggttgtcttctagggtttttatagttttgggttttccatttaagttttactccatcttgtgttgatttttgtgtatggtaaggggtctagtttcaatcttctgcatatggctagccagttatcccatcaccatttattgtatagggagtcctttcctcattgcttgcttttgtcaactttgccaaagatcagatggttgcaagtgtgtggccttatttttgggctctctattctgttccattggtctatgggtctattatggtaccaccacttaaaagtgggcaaaacacataaacagacacttttcaaaagaagacatacacatggccaacaagcatatgaagaaaaactcaatacccccaattattagagaagtgcatatcaaaaccactatgagatatcgtctcacagcagtcagaatgctattaataaaaagtcaaaaaacaacagatgctggtgaggttgtgaagtaaagggaaactcatatactgttggtgggagtgtaaattagttcaactattgtggaaagcagtatggcaattcctcaaagagctaaaagcagaaccactattggatccagaaatttcattgctgggtatatacccaaaggaatctaaatcattccaccatgagggcacatgcacacaaatgttcattgcagcactattcacaagagcaagacatgaaatcaacctaaatgcccatcaatgacagaccggataaagaatacatggtacatatacacaatggaataccattcagccattaaaaagaatgaaatcatgtctttgtgggaacatggatggtgctggaggccattatccttagcaaactaacgcagggacagaaaaccaaataccacatgttctcacttataaatgggagctgaataatgagaactgatagacacaaaaggggggcaatagacactggggactacttgagggtggagggtgggaggaaggagaggatcagaaaaaataatacttggtactgggcttagtacctgggtgatgaaataatctgcatagcaatcccctgtgatatgagtttacctatacaacaaacctgcaagtatactcctgaacctaaattaaaagcttaaaaataaaaataaaaataaaaaacagtgacaacaccaaagactgatgaggatgcagggaaattaaatcagtcatacacttctggtaggcatgtaaacaggtacagtcactctgtaaaacagtttgccaatttcttaaaaaactaaccatgcaactaccatatgatccagaaattgtactcctgggcattcaaacccagagaaatgaaaatttgtgttcacacaaccacctgtacacaatctttatggtagttttatttgtaatagcaaaaaaatactggaaaaaaaacctctaatatcatctgtagactattactcaacaaataaatggaacaaactattaatagaagtgataacctagataaatattcagaaaattatgctaagtgaaaaaagcaaatcctaaaaggttacatattgtataattccatttatatactgtttttgaaattataaaattatagaaatcgagaacagaatagtgattgccagggtttaaggagagagctaggggtgggaggaaaatgattgtgactatgaaaggtcaacaggagggatcctcgtggtgataggaatgttttctttattagctttatcaatgtcaatatactggctgacattctactatagtactgcataacattaccacctggggaaattggttaaagactatgttgaatctctgtatcatctcttacaattgtgtgtgaatcacaattatctcaaagtaaaaaagtttaatttaaaacaatattttaaaattaaatagacctaatttattcatttaaaaaaattatatattttttccagacttaaaatatagattatgaccaaattgttacatattgaccatttaacataggttgtaccatctctgttacattattatgtatgtatacaatatgactacatttcaatagtttttaaattttgttttctgaatttcatcacttctgaaattttaccacactgcctgatcatctttggaaatagggaaaaagagaaagtagattaggagtgagatgtgaaggcaatggatattattgacatttctattcttctgtttaggtttctaaatcaattgaaggaattaaatgacatataatcaagtatttaatggcctgagacttggaggcatgtttcccaaaatccagacttatgtgccactatttattagtaaagattcttcttaaagcaaggctaatactgagttgcataattgtgttgacttacgtactgttaaattctaagtgatccaacaggttatatttcagactaccatctatacaaaacagagcacagagagcagattccatactgtggatcatagttttagaatatttagtaatcctttgagtaaagaaaaaaaattcttaaaacatttctttctggtgacattttgaagccttttgcaggagataaatagaaatatctagattaaaaggaaataactacaacaagttcaaagctaaatatagagatttactgaatatttccacagtcaacaaatgttttcacatttgaaacagaaacatatttaatgagagctcctgggcttaatatatggccaaagttctattgcctgttttaaataacaaccaaaacaggaatagaaaaatggaaatgagtaaagcaaaatggaagttgatatgccaggcctaagggccttcttctgttcctttatattcaatgcttttaataaaaagagaaaatgcctgcatgtcaacttttgcaaataaaaatatatgggtttttagcagtcctaccagtaggatttcagaggcattcttatttctctgaccatatacattctgaaacactttattgttcacacgactatccttgatatcttgatatcttaggtaaacaagctgtttttctttctctaaaacaaagcaatgtttttgaactatgggtacaattcaatgaaatatgaccgaaataaatgcttagggtaaattaagaaagaaacttttgtttattattttaatatttcctacatacaaaaataacatatagtaagcacatcttattttatatatgatatttaataaggaaccataaataaaaaataaaatttaaaggaaacccaaagtatatgttttttgttatacaacattttacctatagctccaatagaaaatatagaaatttttgaaaattttaaatgtaaagacaagggaaaaagagaaatcacaggagagtaccaatttacttaaaagttatcatttagagaaaaacattccgtttgcttaaaaattgagaattatttcatttggagcatcattacacaagacagacttctatatataagtatatcacatatatatggatgtaagtatacatagactcacagaaccactgtcccaggttctgtagaaaattaggtcatatggtgaaatatgaattcaattacaacatgtcagcaatttgaatgactctaagaaataatctggaatacatttttccaaagtttgaaaattgattgcggtatatttcatgttcctccaggttttcacttttaccactctctttcatgcattgacaggtattcttgttttattcctcccagaatctcctcccctatatcatttatctaccagggacttctcagtcctcttttcacttccgcatcactgcatgttcctttatctccttttctgttacaatctcttattacatagtctcctttatggctctcaattccagggttcttctattcttttttctccctcatgaccttacccacttctttagagccagtagcctagtagggggctctgtccagatgttccacgtggattcaaattcatatggtaacatttaaccattatttctctcctggaatgtgttttgctttgaatcttttatcttaatttatgtcaaacattgaactagtcattcatgtcaaaaatcttatttttctattcccattacttatttagtaccaagtgctttcactttgaacactgtcttaaaaatgtctcctcccaccaatctcagccaccttaatcagccctcagcaactctaattactcctgggtaatttaatgaggaaatagctgctaccagccactttttattttgtcttcttcagtccatttgtgtattgccactctacagagccttctagaataacagtctggtcatgttacagatttggtgaaaatcttacaacgctgctttatcaaatctgttctattgaaaaattgttctatcatcaaaaagatatggaaatttgtgttaaacaataaataattttcttatattacaatgtttctaagaaatggaatatgttttctctttcctagagcaagacatacaatggtatacagagttttttgaatctattagatcctaaaacggtttatatgtatcctcccataaaacactacacagaaccagtgttccctagggcacattttggaaaacttaggtcaggattaaatctgacatgctttgtatgtacaaagaaggctctgaacaaagtaatccatgcctaactctttgtgtcctactcatgtacatcattcaatggcctggcctcaacaaactttgtagttctccaagtatgccacaactctctttttcttctttggttaaaatgcttgacttcctattagcagtctgttgaatgtctgtgtattatgatataccaattcatacacaatcttcattcttgatcatatcttgatatattcctccctctagtgaaagtggtcattatcccatttgtaccattctcccagacttaattgtgaagatgagaacgagattaatcatctttttcatccatatactctagtggagtcccaagaacattgacattaaataaatgctttttcattaagtaaatgactgaagtctagttcaacatttaatggacatctcttatgtgtcaccaactataagaattgaatgatgcttttcttatgagtataattatagtacatattttatgagattgttttggtaattaaaatgaatgactgtaaaacatttagaacactgcttgatcagtgctatatgagtttttgttaaaataaaatttaagaaaaggaatactagagctcagctgtcaagtagcttataaatctaaagcagaaaataagtttgcagacttgctgattgtgccaagcagaacacgttaaaataaagttttgaaatgtatgaaatgaagatggagaaataaattccagcagaaagaattgagatggaaactcagaatccaatgttagtgaagaaaaagattctgtaagtagaaagccagcttcagagtggctggtcacttgaaatttgtgcatgggtatttctcctattgatgaggagaagcaagaagtattcaaccttaattgtcccagtcattttcatatgcagtccatgtttaatgttgaactaaattctagtatttattttacttaagtcatatgtaaaacagtctttttagtatagtgatttttagtaaagtggctgcttcagtataattatctaacactgataagtaaaataagtaaacaattatttttttaaactttaaccaaatgcttgtttcagacacttagataataatttaaaagtactaaaatatctagaattttcattaaatatttaatgaacaagagacttagtaagtgaaaagagtagatgttaatataacttaagtctaataaaatatctttatttctctattcctctttctagacagatactcttacatgtttatatctgcaggacatgtgttcctagagttatgaaatatattaaaattttgtttggtgataaatattttccagaaataataaaattagaaaataaacatatatgcaataattttaccaattttacaattataggattgatttaataacttggagatttataacatgatattactgtgaggttttctttatttttctaagttaaaaagcatcacttgatataaaaatattaactaatgacttcgtttttgtgtttggctgttttttacccttctagtgacaagctactagggatataacaactctttattgttaagcttctaataatcttgaaaaacatctcctggctagggaggaaggaatctaaaaatgtctcattaaaataatcatttggtaacttttttttaaattttcttcaaaatcaagcagaattacagcacacagactccaaaagctaaacgtgagtacatcctttccagatctaattaatccacaatttgtcacaagaaatttattctacttatattcattttctgaacaatctccgccactttcgggttcttctgacaccccacctctaacctttgatatgccggtaaaattggagagattgccacactattttgtgattaagggcaatttcaaaagaaattgagttctcatgctatagagcaagaacttacctaaagtagtcaagaaacaagagaaaccagaaattgttttacatgagacagatctcatatttttaaatatagtgtaccactttcttaataagtaaaattaaaagaaaaatgtaacttaggatacagaaagtcctaaaggaccattactccctcctaagaataacaacaaaatataaaagttaccagctcaaagaattagctaatggttgcttttatccctagcagagaaacaggagaggattttgtagtacgcctgggatatattgtgttatgtattaataaaattgatgaaaaattgagttttgttttttgttttttttttttgagatggagtctcgctctgttgcccacctggagtgcagtggcgtgatctcggctcactgcaagctccgcctcccggattcacgccattctcctgcctcagcctcccgaatatctgggactgcaagtgcccgccaccacgcctggtttattttattttattttattttattttattttattttattttattttattttttgtatttttagtagagacagggtttcaccgtgttagccaggatggtcttgatctcctgatctcgtgatccacccgcctcagcctcccaaagtactgggattacaggcgtgagccaccacgtctggccaataaaattaaattttaaactaacaattaaaattttaatacattcagaaatattcatgcagggactgtggtggattacaatatcaaggcacccttgctatggtgtaagtctacccattcgaaactctttcccatgggccttcattgagcacactgaaagtatagagtctgggagtcacaccagtgggttgaaaaaaattctttcaagtcctctgggcctttattgcatccattgctgcagtctcaaataggtggacataaagcatgagaggtaagacaattctaccaggcaaccagggtttttatgcaattgtctccagcagctgtccaaagtctagaaacaggcttcaggacaggcaaatatctcttgaggttcagaaagtctggcaggactagacagcaataaaattttccagtaacccacaaagtcatcacccaggctacaaagcagagaatgatgttctagagtttggaaagttgacagctatctgcaaaatatttaaaaaattgggattttaatcttgctcagatcccaagtcttgctgaagacgtcataatctcattctcaaaatacttgaaagctgtgatcaattaactcgaaaccaaactgagaaccagtctacctgcagattaggttaaatcaggctccctcagtttggcaaactaggaaaattacaggaaacatttaaaatattctaggccgggcgcggtggctcacgcctgtaatcccagcactttgggaggcggaggcgagcggatcacgaggtcaggagatcgagaccatcctggctaacatggtgaaaccccgtctctactaaaaatacaaaaaattagctgggcgtggtggcaggcgcccgtagtcccagctactcgggaggctgaggcaggagaaaggcgtgaacccgggaggtggagtttgcagtgagctgagattgcgccactgcattccagcctgggtgacggagtgagactccgtctcaaaaataaataaataaattaaattaaattaaatattctgaggagaaaattttatttactacaatgtttgtgattctttcccacacaacgttcaacatataataaaaaattatgagtctcttgaaggtacaataaaatatgacccatggtctaaagaagaaacagtcagttggagcaaccccctattttggattcagttgctggaatcatcttatagggattcttaaataactgtgagtactatgctaaaagatctaaagaaaaaaaggggacaatatgtgcaaagacaaggtatgtcaacagagattgaaactataaaattaattctgatagacaagctagaaacttaaaacaattcatattagaaatgaagaatgtatttgaagggttcaaagattaaaagccatggagaagataagtgaatctgaaggctttccatagtaatcgtctaaatcaacataaagagaaaacttatttaaaaagatcagagcatatgatgcctgtagaataatgacaaatagcttctcacacataattagagctagagatggagaagtaaaaaagagtggaacaaaagaactacttgaagaagtatgtagtaatcattttctaaaattgatgaaaagcataaatctatagttctgagaagccagcaaactacaaacaagataaagtcaaagaatcaattatctatgtacattaaaattaaactgcttagaagcaaagaaaaccagaaaaaataaaagcagcagggttgatatatcacatcatgacatcaatgataagaatgacaattgacttaagaaacactggggctaggagacactggaacgaaatctttaaaatgctggaaaaactctgttaaggattctttacctgtatctatgtttttcaaaaagaaagaagaaataacacttttaggcaaaataaaagctgagataatttgtcttcggcatatttataatataaaaattactaaaaatacttgtttaagctaatgtaaaattatatcagacaaaaatccagaactccagaaaaaactaagaacccaaaaaagtaaatatatcattaaacataaaggacatttttcataacacatatatacacaaacataactacatatgcacatgcatatgcatatgtatttaacataattttaaagatggttgattggttaaagcaaacataacaatgtattatagggtttatatcacatgcagaagtaaaatatgtgacaagaggacatagagagataagaatatacaaaactaatctatggtattagaaatcataaagttgttggggcaggggtgggttaattagaaaagtggacaagagaacttttgctataatgggaatattttctattttgctttttgtgtaaatgggcatataaaattgtcaaaaatcatcaaacctaaacccttagatctctacatttagagatctaaatttagatctctaaattataaaaataatattaaaaataaaaattgaatgcatacgaatttagcatgatgaccatatttattttcttctttcttgttttggtttcaaggcatttaaattagctactaaactttttttttaatttgaatttttacttttcttggttttctttaccaaattttctaaaatgagtctgtgttatcagagaacataaatataaatctgttctatgtgaaacgaacaaatgaataaaataatagcattgcctcagcaggaagaaatcttgtttctcaataagatctttcagtttacattaatcattcaataaataagccaaagtaagccaaaaatcttagatttcatttttttctgtatttttctttttcccttttgctttcattctgcttctctgatgattatgtactttcttgtcattgctcttctttcctctttctcttttcatttgacttctaatctttggcctgaaaatacttttttcatctggttttatcaactaatactaaaatttggctgttccaattaattattttgcaactttgttagccctaattctgaaacaacaacattttctctcaatacattgcttaattcaacacattctgaggaatttaacaccatctttttttttttttccaatggacaatcatcagggaattagccaataatgagctagtgatattggcaaactgacatacagtatgactgttcaggcctttgcagacatccaatttgcacacaaaggtgcatgcacacacacatacatacacatacacataacacctatatttttctcaatgaatctcctttttgggtgtatctactaaacttcctctttggtcttgcctgtccttgttcattgtcttagtttgagatgcagctcattctacttagttttatgcttgcatctgacctactgattatcttgccttcccaacctttatgtgagttggcatttttagtctccctttctttgcactctaaactcaccaactcccaaattctctgggaatgttctttgaccgatattgaacaaaaattctttttaagtctgagaataagaattttttaaatctgactttaaggccttagaatactactgtttctcttaccttctgattaatatactcctgaaataattatgaaatcataaatgaacaaatctcattatgtcaaaccaggcattaagtaactcaagttgaagaacagaataacatgtatttaggatactaagttgtcataccaaaattaccttgggtctacaatcacaaaattaaaatcagccaggcacagtggctcacgcctataatcacagcagtttgggaggctgaagcaggaggactgcttgagcccaggagtttgagaccatcttgggcaacatagtgagactttgtttctaccaaaaaaaaaaaaaaaatcagccagtgtggtggtgtgtgcctgtactcccagctacttgggaggctgaggtaggaggaatgttgagcctgggaggtcgaggctgcagtgagccatgattgtgcccgctgctcttcagcttgggcaacagagccagaccctgtctcaaaataaaaaaaaaagaaaaaaattcaattaaattcattaaaacattgacggattaaaatgatttttctgtagcttttaagggagtatgctatcttaagtagttaaccatttttttgtcattttaacttatttaaatgtcaatattaagttcaagaacattgatataaaatatcatcttaaccttagattaagacttgcattattatattaatcattttacaacttacttctttaaggcttagttttatttttaattcattgttttattagactctgatgagaatatgaatttttaaaaagtttgttttctaataccatatatcaactatatgttattaaacataattttagcatctatttttatataaatatgtcaaaaatcacatgaaaaagcaaattatagtgtgtattttcattcatatctttttgataaaaaaactatattaactaatgataaataatttattattctgtatgaataaacttcttttatctgaagtcctcttacctgcttcgggaaaacaaatgtaagggaaaaaacaagtaaaacaaatggaacaaaaggggaaaataaaaaagatcttcctaataaactatgtaacagagatcattcaccttaactgtcagcaggaattccagaataagtcatttattcagtgatggtaacttcacaacattatgacgacaattacaggtactctctattacatggtttaacattgaacctcaacttgagttgagtcagtgcactggagtagcaaaataaataactgtgacattttgaaatgtctgcatatcaccaatatatgcattgatttttcattttaaaagtctaccctttttccaaattaatctttatattttctccccaaaatttgggtaatgcatagggctacatcctacttgcttgaaaagtgaatggaaccattcatatagttataagaatctctacaaatagaaaagaaaatttagtaaaagagagataaatagcatttaccatttggcttataatgtaaatatcatgcaatgtccttagttgaagacctgtacttattaacaaaatatatatatataaaattatatttatttctttacatacataaaaatatctattttttaaataagtataaatctttagccaatcagattatatgatttttaatttaatagaccactttgtccaagaatcttttttccctcaattaatatacatttgtttatgtattagagctaaatttatgtgtctctttgtaaaatttatttattttgttttttttttattatactttaagttttagggtacatgtgcacaatgtgcaggttagttacatatgtatacatgtgccatgctggtgcgctgcacccactaactcgtcatctagcattaggtataactcccaatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctaccattgttggacatttgggttggttccaagtcttgtaaaatttattttgttgaacacatggataaatcaatacattctgactttttaaaaagtccattttgttgattcctatttctttgacagtaaaacatatatttttattcatatggcttttctctcaaaatttatcgccctaatatttaactttgccttctatagctgctcaaagttacttattagacttccacttaacacataatctctcttgtagagtacacttaagtattttttagagacttcatgatgagtacttggttgtccctaagtttttctgacaattttgttattttaactttcatttcttgttcttaaccctcttaaatgaaacttcctatttgtgatagacttattcttttgttcttgactttccattgcaaccacctctggggtaatatttttaaaagaatgtttagaaatcaaataggagtttagctaactatgaatgagaacatattttcattacatgtttgaggaatagattttttactgggtaagagatctcaggcacaattctggctaactaaaatattggctttagctacataaggtaagacatttaataagtgtcaggtctataccatagatgtcatgattaaacaagctactaagtgtatagctaggatgcattaaaaaattgttcgggaaatttttggcagaagaatattatccagaatcagatttatgaggatgcagtaaaagattaagattttggctggtgctcatggtaatacggtctaagggaaccaaggttttatttaagcttgaggtatgttgatgtactacctaatggttatcaaatttttgtttccaggaataaatgatttagacaaattagttcataattcattaggagaaaaatatattgcttaaaatctattgataactaaagttgaataacttttaataactttgatttctgaattgatcattggtattttctttctggagccagaaataggcaaattctataattggtaaggtatgcatatttagtcttttataaagatggctttcaaggttattcaaaaccatatagtgtttttgcttttcataatatctatgcccttaaatcattttctgtatgcttatttgagattgttccttctattaggtcaagattttataaatttcaaggactattatcctgctatagtacagaatacatttgaaaggccagtggtgatagtgttttccacccagataacaatactaataaattatttactaagtgcacttattgtgtccaaggactgcaataaatgctcagcatgcatctcctttaactatcataaaaaaatctataatgggttttaattatgaccacattacagatctttttaaatgaggcttagacaacttaaattcccattatcaaatggctagtaagcgtagaactaggattataaaacagatccatttgaactcaaaatccatgttctttctactccaccaggaataacatatctagtaattgcgctgctaaccttttatgatgctcatccccgctgagcccagatgtgctctaaattagtgctcttatgttcaaatcaatcacccgagaatcttgttaaaacacagactgtcatataaatgtggaatcatacagtaattgtcttttgtgactggcttatttcacttagcataatgacctcaagttctgtgcatgttgcagttgttgtttaatgggtacagattttcacttttgcaagatgaagaagttttggagagtggctgcatgacaatgtgaatatacttaacactacagaacttcacacttaaaaattaagttagtaaattttgtgttatatgtattttaccacaggttttaaaagtagactcttagtggggtacagaggctcctgtctgtaatatgagtattttgggaggcccaggtaggaggatcgcttgagaacaggagtttatgccagcctgggaaacctagcaataccctgtctctagaaaaataaaaataaaataaaataatcatctgggtgtggcagtgcacatctgtaggcctagttactcgggaggctgaggtgggaggatagcctgagcccgggagattgaggctgcagagatgattataccactgcactccagcttgggcaactgagtgagaccctgtcttaaagaagccagaaaaacaaaacaaaaaatggaatcttatttgctgggtctgggatgagcccaaggtgatgctgatgccactggttcataagcaccctctgccatgcaagggtatagatatttttctccagggtgacctctaagaaaccactgccatttgatttgaattggcatgtaagatattaataaaacatattgagtttttgctatctactatactttctttccaactaacatgcatgtcctcattcacactagtaggacaggtgagcaaaaagtgcccattgcttctgatgcccttcaatttcctagacagttcagattctaagaatgtctttggccttggaagcatttttgtcttaaacttctgaaataattgtgtcctgaaataccttttgtgatatttgttgaaaagtttcctcctactctgagagctgagaagagaggaaccatttccaagctgctgctacatatcaaagagcctgtcttttcagcttcactgacaagtggaatgattttccggagtctgagaaaatatcaggcaaaatcttttccagataaaaaagctgctgtcagctgcctgcagctgaggaagcaactttaaatcctgtggggagaatttctattgcaacctcaatcccagattccagcttctgtcttacatccttttttggcttgactctgctcaaggagctcaccaaactaaggaaaagaaagttagcaggacctacgggtctcaccttcacactgccaatctcaaagttttctcttgaggaaaccatggtaacagacgcctgttcagagaagcaatgtaaggtgattatttacacataacctattgtgctttgtagccccaccctcacatgataaagccaatagaaattgatgctgaggtccaagtacagatttttttttttttttttttttttttgagatggagtctaggtctgtcacccaggctggagtgcagtgacacaatctcggctcactgcaacctctgcttcccaggttcaagcaattcaccagcctcagcctcctgagtagctgggatcacaggcatgcaccgccacacccaggtaattttttgtatttttagcagatacggggttttgccatgttggccaggctggtctcgaactccttacctcaggtgacccacacgcctcggcctcccaaagtgctgggattacaggcatgagccatcatgcccagcctacaggttcttctaatacctaattgaagtgtcctgacatgacaattttatattacatggcaatgtgctatggcaataatatcttctgatttgggaagtgaatatgatacaaagagaattaacaggaaagcagagaatcaagagatgccttctactatgaaaattattcccagagctgcactgaccttgaaactcacctgttgctccacggcggctgagttaatttttctttactttcccatgtgtcttcccaatatatttgcattcattggaataatcctgagttctcttgatttcttgcaaattgaaaatgcctaaacacagaattagttttgcccattgatcaagccttaataaatcttacagattctggccttgaccaaggctatgatctccactccatcagtgactggcctgagctggctctggaggggtccggccaggcctcttactaagttatctttatagttttcatggcacctgtactcaggggcagctctgttttgtatttagaaatacctcattttcaagaaagatatctgttttcattattcctattatagtcccagcagcctttaaaaaaatgtgcttagccagtcaaaatgataatcttgagatttttctaactttacctttttctcctacttatttgcttagagaaaagagtggtcatctacctctccaaactgtatgccaccactactgtgctcttaactaatatttctgatttgtcagttaggaattccttcctctctgtttcatttttttttcagaagcctccaacataccatgttttctattctttcttcacgtattactaaagtatattttcccttcccttccatatttgctattctttcaactttgccattcaccttcctaatccactgatatttcaggaaaggttctttttccatttctgctatttattaccatgtggcttacttcatcctactgagacatcatttctacatttgtaaatggggattaaaaatgcctgcatttcctactttgcaaggatttgtgagaatgaaagatggtaatacaatggaagtgttttgtagttataaagttttacatattatctagagaactatcttgctttcattttatacggtcagaaacaagatattaaataaggaagtgctctcagaaagaaagacctttgcatttaaaaatgtggttcatcatttatatttatttagtcacacaccattttaaaaagtgtcattacttttttatctgtatgatatatattatttttggacctgaactcacagtttgttaaaatgcaaagataaatagaaatcagaaagctctgaatattagttgtcaaaaataataaaatagttcacctctgaattttgatgagcaaatcaacaagttcagttttccatcaagaaagaaaaatagctgtctcattcaaatacattttttaatttatattatattaatattgctgtcacagtgaccattatgacttcaagtaatctatgtaaacatcatctaacaaaatgtacctgagaactgtgtttcatgcttaccaatttattattctgcctatttggaagttctattattactagcatacatagtttatatacttcttcccttagggaggaaaaacctctcaattatactgtttattagctaagacaagaactctagcatttacctgaatataaagcttttggatagaggagacatatagtttagtgggaattttgggcacctaagatttattgccagatattcttgttaacttatttggtctacagtgattgtgaaagtaggtttttgagccttgtcccctttgtcattccaaaactgagattaaagcaatgctcaattttacatttaagatgaataaagtatgattataaaataacacatataaaatgaccaaaaattaataattaattgtctgatgtggaccattcaagcacatcagacacctaacaattaggatagatgagcatctttcatgaaaggaaagttagcatctatatttttaaggaggcatatgataataaggactacagagcaattactttgagagtgcttctactgtcacattttagaagaggttctaatgcaagatttctgtttcatttcttatttttaattttaccaagaaactcttgaatttgcaattgtataccacaaataaatgcattaggtacaagtgcctcaatgtcctaggaaattgatgtcttagttcaaaaggaaatgctgttacagctttataattgagtcatataatttccatggttgagtagatgttggctttcaccggtccttgtcctttaaagtccaccacctgacacatcaccacaaagaacaggtaatttattattttttattgccattaatttatagctttaagtttcaaaggagaattataagttaccacaatatctggagctttttaagttttgtattcccctttgactgcttaggataatctaaatcaccagagattagaaaagaatcatgaaataatgttcaaattacggaaaaacagactttaaaaaacagtattaaaatggaggtaaattatcttagtggattatttatttctgacagatttgcctatattgtagttaaagaaattggcttttttccttgatttataatgattttatttatagaaaaaatataatgggacaaattttctttggatctaaaatttttcttaaaattcaaaattcaaatgatagttgtggtattataaatttggattctattttatttaaaatgttgccacctctgaaaatggcttaaaggctctatcacaaaatgtttgctagtaaaattaatacaatacaatctagctgtattaacacagagcaccaatcaactttaccaaacactatttgcaaataaacatttgtaatcaagaattttggagacttaaaatccatctcacttacacactagttattgaactttgaggtccagagaagaaaataatttatcagtttcctatcctgtgatgtgagaataataacaggcatatcatagaaacttgtgaggattatccctcttacattcatacgaaaactaaagtctagagaggctaagagatcttaaggtatcacaaagagaaacttgtaggtttagtattcaaactttatatgccctgctctaaaatgctacattttccttgataagcacataatcacatacagagtttcagattatttaatttcttattcatagaaagaatatgttggatgtataaaacatatttcttaggaattattatctacaaaacgggttttaaaatactgttaactccaatcacttaacagtttgagttgttttggatggttcaccagtccctataactcttgcagcttactgccatttgggtttctcagacaaaaccacagccttctactcgatttgagaatttttctttttaacctgtacactcgctaagagaatacaatttggaataagttgacagaaatagctataatagtatatgtagttgcacactgactgtttcagtcaaggcacaatcagggaaagaaagtgttgcaattaagtgaattcagatcaaagatttggttaagatggtaaagaaggagctgaggaccagtcagaacacagtaaaggaacatacatattaggaactgcaggaaaccatctagcactcctagactggagagagaaaggaaaattgtggtgtcacttgaagtagcaccagtccctgaacagaagctggagatggagacatggaggacatgtagtcactttaagaatacccttcaaaaaatcaatgaatccagcagctggttttttgaaaagatcaacaaaattgatagaccactaggaagactaataaagaagaaaagagagaagaatcaaatagacacaataaaaaatgataaaggggatatcaccaccaatcccacaaatatacaaactaccgtcagagaatactataaaaacctctatgcaaataaaccagaaaacctagaagaaatggacaaattcttcaacacatacaccctcccaagactaaaccaggaagaagttgaatctctgaatagaccaataacaggctctgaaattgaggccataattaatagcttaccaagaaaaaaagtccaggaccagatggattcacagccaaattctaccagaggtacaagtaggagctggtacgattccttctgaaactattccaatcaatagaaaaggagggattcctccctaactcattttatgaggccagcatcatcctgataccaaagcctagcagagacacaacaaagaaagagaattttagaccaatatccctgatgaacatcaatgcaaaaatcctcaataaaatactggtaaaccaaatccagcagcacatcaaaaagcttatccaccatgatcaagtgggcttcatccctgggatgcaaggctggttcaacatacgcaaatcaataaacataatccaggatataaacagaaccaacgacaaaaaccatacgattatctcaatagatgcagaaaaggcctttgacaaaattcaacgacccttcatgctaaaaactctcaataaattaggtattgatgggacgtatctcaaaataataagagctatctatgacaaacccacagccaatatcataccgaatgagcaaaaactggaggcattccctttgaaaactggcacaagacagggatgccctctctaaccactcctattcaacgtagtgttggaagttctggccagggcaatcagacaggagaaggaaataaagggtattcagttaggaaaagaggaaatcaaaatgttcttgtttgcagatgacatgactgtatatctagaaaaccccatcgtctcagcccaaaatctcctcaagctgataggcaacttcagcaaagtctcaggatacaaaatcaatgtgcaaaaatcacaagcattcttatacaccagtaacagacacacaaagagccaaatcatgagtgaactcccattcacaattgtttcaaagagaataaaatacctgggaatccaacttacaagggacgtgaaggacctcttcaaggagaactataaaccactgctcaatgaaataaaagaggatacaaacaaatggaagaacattccatgctcatgggtaggaaaaatcaatatcgtgaaaatggccatactgcccaaggtaatttatagattcaatgccatccccatcaagttaacaatgactttcttcacagaattggaaaaaactactttaaagttcatatggaaacaaaaatgagcccgcattgccaagtcaatcctaagccaaaagaacaaagctggaggcatcacgctacctgacttcaaactatactacaagggtacagtaaccaaaacagcatggtactggtaccaaaacagagatatagaccaatggaacagaacagagccctcagaaataaggccgcatatctacaaccatctgatctttgacaaacctgacaaaaacaagaaatggggaaatgattccctatttaataaatggtgctgggaaaactggctagccatatgtagaaagctgaaactggatccgttccttacaccttatacaaaaattaattcacgtggattaaagacttaaatgttagacctaaaaccataaaaaccctagaagaaaacctgggcaataccattcaggacataggcatgggcaaggacttcatgtctaaaacaccaaaagcaatgacaacaaaagccaaaattgacaaatgggatctaattaaactaaagagcttctgcccagcaaaagaaaccaccatcagaatgaacaggcaacctacagaatgggagaaagtttttgcaatctactcatctgacaaagggctaatatccagaacctacaatgaactccaacaaatttacaacaaaaaaacaaacaaccccatcaaaaagtgggcaaaggatatgaacagacacttctcaaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgctgtgtccagaattggtgggttcttggtctcactgacttcaagaatgaagccacggaacctcgcggtgagtgttacagttcttaaaggtggcatgtctggagtttgttccctctgatgttcggacgtattcggaatttcttccttctggtgggtttgtggtcttgctggctcaggagtgaagctgcagacctttgcggtgagtgttacagctcataaaggcagtgtggacccaaagagtgagcagcagcaagatttattgcaaagagtgaaagaacaaagcttccacagtgtggaaggggacccgagtgggttgccactgctggctctggcagactgcttttattctcttatctggccccacccacatcctgctgattggtccattttacagagagccgactgctccattttacagagagctgattggtccgttttgacagggtgctgactggtgcgtttgcaatccctgagctagacacaaaagttatccacctccccactagattaggtagatacagagtgttgacgcaaaggttctccaagtacccaccagagtagctagatacagagtgtcgattggtgcattcacaaaccctgagctagacacaggttgctgattggtgtgtttacaaaccttgagctagatacagagtgccaattggtgtatttacaatcccttagctagacataaaggttctccaagttgccaccaaactcaggagcccagctggcttcacccagtggatcccatactggggctgcaggtggagttgcctaccagtcctgcaccatgcaccctcactcctcagcccttgggtggtcgatgggactgggcgctgtggagcagggggcggcgttggtcggggcggctcgggctgcgcaggagcccatggcagtggggaggctcaggcatggcgggctacaggtcccaagccctgccctgcaaggaggcagctaaggcccggcaagaagtccagcacagcagctgctggcccaggtgctaagcccctcactgcccagtgccagcagggctggccggcagctccaagtgcgggaccagccaagcccatgcccacccagaactcgtgctgcagccctggttcccgcctgcgcctgtccctccacacctccctggaagctgatagagccggctccagcctcggccagcccaggaaggggctcccaccatgcagcagagggctgaagggctcctcaagtgctgccaaagtgggagccaaggcagaggaggcaccaagagcaagcgagggctgcgagggctgtcagcacgctgtcacctctcagtgggactgtaaactagttcaaccattgtggaagtcagtgtggcgattcctcagggatctagaactagaattaccatttgacccagcaattacattactgggtatatacccaaaggattataaatcatgctgctataaagacacatgaaaacgtatgtttattgcggcactattcacagtagcaaagacttagaaccaacccaaatgtccaacaatggtagactggattaagaaaatgtgacacatatacaccatggaatgctattcagtcataaaaaaggatgagttcatgtgcttcgtggggacatggatgaagcaggaaaccatcattctcagcaaacaatcacaaggacaaaaaaccaaacaccgcatgttctcactcataggtgggaattgaacaatgagaacacatggacacaggaaggggaacatcacacactggggcctgttgtggggtgtggggaggggggaggagtagcattaggagatatacctaatgttaaatgacgagttaatgggtgcagcacaccaacatggcacatgtatacatatgtaacaaacctgcacgttgtgcacatgtaccctaaaacttaaagtataataaaaaaaaaagaaagaatagctgctaaggcagagtaagaggagaaacatctgagctccttcctcccaactgttgcccatctctagaggctgactcagctggaattcaggtaatgtgggatccaaggaacagcgtctacagtgctcagccttcttaatatatgatcattactctacaagctatggcatgtttgatttgagaagcactcaaatcaccttattcattttatcaaattcggttctttcttctgactaagtactaggtactcaatagctacaaaaactatcctccaaaggcagaaacagcatcttacacttagttattggggataaccatgataatattccctcaaagcagattctcacacacagatactcatccactcagtacgtaaaacctgaccttcactctgcctcaccgtatcataagcaaaggatctcaagtgaagaaacaaaaactgacatgttcctggaagatgccaatggtactgctataattatttgtcaaagaatgcaactaatatttttagaatttgtccatgtcatgattctcaattttttagttgatttttgtgtcacgtttctttttctatcacaattttaataataagcagcccttccaaccacctccacaggaggaagattaactgtgagatggttaaggaaaggcaatgctaatcaatgatgtggccaattctttctgcaacagttatacacattgttatattccgggataaacttctcctgcccactcataaatttttatttccttctcctctggttttatggttaaattaatgaaaaataaaacttttcagaaggtagctgactcttcatgtgatttcaaacttaccaacaggaaatatccaatatacactccttacgccttcctacagcacatgaaatcttttttttttttttttttatactttaagttttacggtacatgtgcaaaacgtgcaggtttgttacatatgtatacatgtgccatgttggtgtgctgcacccattaactcgtcatttaacattaggtatatctcctaatgctatccctccctcctccccctaccccacaacaggccctggtgtgtgatgttccccttcctgtgtccatgtattctcattgttcagttcccacctatgagggagaacatgcggtgtttggttttttgtccttgcgatagtttgctgagaatgatggtttcccgcttcatccatgtccccacgaagcacatgaaatcatccttttttatggctgcatagtattccatggtgtatatgtgccacattttcttaatcgagtctatcattgttagacatttgggttggttccaagtctttgctattgtgaatagtggcgcaataaacatacatgtgcatgtgtctttatagcagcatgatttataatcctttgggtatatacccagtaatgggattgctgggtcaaatggtatttctacttctagatccctgaggaatcgccactctgacttccataatggttgaacttgtttacagacccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagccaatatcatactgaatgagcaaaaactggaagcattccctttcaaaactggcacaagacagatgccctctctcaccactcttattcaacataatgttggaagttctggctagggcaatcaggcaggagaaggaaataaagggtattcaattaggaaaagaggaagtcaaattgtccctgttttcagatgacatgattgtatatctagaaaaccccatcgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggatctcttcaaggagaaatctttgtttttaatattgcttttaattctaatagtaattacttgaactggccagaaacagaaattcctcaagtgcttagcagaaaagcctagctatagtagcttcacactttttctatttttaggcaattacaaatatattttgaatttggaaaataacatataatttaaatgatatacacacgcatatatacacacacatatatacacatatatgtatatacatatatgtgtatatacatatatacacacatatatacatatatacacacatatatatatatacatatatatatgcagtaacttcctaataagtttatttaaatttatctgattttaggtgaataaaaaataaaggtttggagagtacctttttaaatgtcagaggaatccaacaaccaattgtacaagtgaggggcagaaggagtctttgatttgaggatacctagtagctgttgttgcacatctgatcactttgcctattcttcttactacctgggtgtcaaatcaattcagaaaaataatctggaaactgtaaaccaaaaataaaattctaagcacccccaatcaactgaagagacccctcatctcagccaagtgcattcttttttttttttttttttgagatggagtcctgctgtgttgcccaggctagagtgcagtggtgcaatcttgactcactgcaacctctgcctcctgggttcaagctattctcctgactcagcctcctgagtaccaaggaccacaagcacccgccaccatgcccagctgatttttgtatttttagtagagacagggtttcgctaaaactagtgaaaagcattttcctttatagaaaaaattttcacacactaacttccacagtggttgaactagtttacagtcccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagcgatattgggcaggctggtctcaaactcctgacttcacgtgattcacccaccttggcctcccaaagcactgagattacaggcatgagccactgcacatggccatcagccaagtgcattctaaagtaaaccagaaaccctagttcaggccatgataggaataggtggtcagacatgcctcattatacctccctcctgttggattaatttgggcacagctggccagcattaacactaaaacagaaaccttaagacggacagaacagactctttgtagcaataagatacctacatgacagcaggttctgaaagaaattgaagtattaatattttactcccaaacatatttatttgacatattttgaaatggccccgcaaagctgtctcttgtcggggaaaatctacattctgtagagaatccttttccctttccaggtgtttttactgatccggagtgaattaacaaagagtctggcacctgttaaagtttgacaagaaacatttacaatgtcttctctccgaagcctgctacctggagccttcatctgcataataagaacccgggtctctaaaacccctgatcttaacccagacagtcccttctgttgattcctgatctttagatgcactctttcaactaattgccaattagaaaatctttgaatttggcctggcaaggtggctcacacctgtagtcccaggactttgggaggccgaagctgacagatcatgaggtcaggagtttgaggccagcctggccaacatggtgaaccccccccaccatctctactaaacataaaaaaattagccaggcatggtggcgcatgcctgtaatcccagctacttgggaggctgagacaggaacatcacttgaactggggaggcagaggttgctgtgagcagagatcacgccattgcactccagcctgggcaacaagtgagactccattcccccccgccccctcccccccaaaaaaagaaaaagaaaatctttgaattcagctatgacccagaagttccctccctacccacttcaagttgtcccgactttctgtacagattcaatcaatgtacatcttgcatgtattgattgatgtcttatgtctccctaaaatgtataaaaccaagctgtagcccaaccaccttgggcacatgttctcaggatctcacggagctgtgtcatggggccaaggtcacttgtattttgctcagaataaatctccaaatattttacagagtttgactctttttgtcaacaaaatgtaaagcattaaaagaaattagccagcaatatacttaattatcatgagcatagtaagcgattttagttttcctttcatcacttattaatatcttacatcaaatttatttttacactgacaggattatatcccttctttaaagctttctatttatagtatgcaatgtaatatggaggttactacctacttcaagcatagaaggcccatcctttatactccacaggcttgtagcacatttatatctgagaattactagtgaaaagcttcctttaacagttttagaaatgaaaatcaagaacatctgtgacttttgtttgacccccccccccccataggcagttacaaggcaaatgtgcatactcctctagcaatcactatagcaacaagcaagtaattgctttaaatagcataaggtgcctttgctgaaatcatttcaagtatcctgagttaactctgtgtcaacaaagcactcataggtcttggattctttaatgggggttcttttaaaaaagaaaattacagctttgtaattggtcatttaaaatttcagaaaaatgtagatacaccaaagaaaatgtattctccaactatgaagaaataattggcaaaatagtatcattttcatattcctaataatttttcctatacatatactgtatgtgtttatttatatttcttatttcttactataagactttaagccagtgcttgtgttacctgttttcattgccttcttacaattatcttatacagatatattataaaataaactcacttttaaaatattttctgtgataagattatgaaatggcatccaaagggaatcacacacaggattttttattttatttctgaaaaatatttgtaggttcaatttaattatcatatattgaaaggtgcttagtgcttttttgcatcagacaaggtgaaaaattcaactttcaaatggctatagtccctggcttcttattttcatcttagcaaaataaaacaacaccctacttatgaattgaaattgtaatgccattccattttctgctataccatagaaataactctaaatactaaaatgtataaagtggaaaatgctgatagtattccaatttgtttcattttcaatttgaagaaaaaggatatgtgtctcctggggtgaagaaatgagtcaattaggtatagaagaaggggcatgactatatcaagcttacactaaaaatgctgaataacaatgacaaattagataattattaataagtagataattccaaccctaaaaaacaaaagaccttgcatggttaatatacaaatgacttttagaaacataaacataaatggaagccaaggaaacaatcaactgagtgaagaaacaacttgtggaataggaaaaaatatttgcaaatcatattttcaataagggattgttattgaaaatgcataagaaacttgaataatttaacaataaggaaacaaatgacccaatcaaaaaatgggaaagatctgaatagacatttctcaaaagaagacatacaaatggacaatatatgaaaaaatgtttaatgccactattcttcagaaaaatgaaaattaaaaccactcctcagctcctcacagctgttagaatggctactatcaaaaagacaaaaagtagcaagtgttggagagaatgtggagaacagggaatccttggacattattaatgagaatgtaaacaattataggcattataaaaatatggaaattcctcaaaaaattaaaaatagcactaccatatgctccagcaatccctctacaaagtatatatccaaaggaaaggaaatcagtacgtcaaaaagatatacttcctttcatgtttactgcaacactactcacaatagacaagatatggaatcaacctaggtgtccattaacagatgaatggataaacagtcatataaatatgtatatctagtataaacacacaccacttataaagaagggaaatcctattatttcctacaacatggatgaacctggaggacactatgttaagtgaaattaggcacagaaagacagatatcacacagttttacttatattttgaatctttgaaggggtagagaggagaaaggtggttatcagggaattaatgggggggtagagaagtgaggagatgttggacaaaggataccaaatttaattcatgtagaagaaataaagatacctaatgtatgacacagcgactatagttaatgcattgtattcttgaaaattgctaagagagattattttgagtgttattaccacaaaaaatgtgaggtaatgcatgtgttaattatcttgactaagccattccacaatgtagaaatatttcaaactacatcatgttgtacacaacaaaaataaacaatttgtaatataaaaaataaatttaaaaaatatatgtacaaaaaggaaatacagatggcaaatatgcatgtgaaaagatagtcaaagttattataataatgaaaatgatcaaatcagggtaattgggatatgctaggaacatttaaatcacacattacatgaatgtattaaattatcacatgtatattgaaaatatgtacacctattatatcatttcttctgaaagtgaaatctaaaatactgtacacaccacaaggatagcaaaaattaaaacaagaacaaaagcagacattaaaaactgctgaaaagtaaaatctaaaataatactgaaaacaccactagaatagcaaaaattaaaagaacaaaaacagacaataaaaagtgctgacaaggatgtagagaagccagaactctcacataatgctagtgagaatgcaatggtacagtcattttggaagacaatttaaaagtttcttttgtattcaaacatacacttaccaacaactgataaattttacttttgtatttactcatgataaataaaaatatttgtcttcacagagacgtatgcataaatgtttatagcaatgttattcaaaattgacgagaactgaaactaaatttttattatgtggagaatagattaaaaattaaggtatattcagacaatagaatattatttaacaatcaaaatgaatgaactatgggtacatgcagcagtaaagataattctcagaagcaatgtggtaagtgaaggaagctagacacagagggtctgtggtgtatcgtcccatgtacatgatatttgaggagagaaaagcctatcaggataaaaatactatcagtggtttctgagggtccagagtttgagtgggggttattgactacacaaaggcatgagggaactttttcagaaaatggacatattctatattttgattatatgtaaactatacatctatctaaattaatcaaattatatatatacaagggttgaattatactgtataaacttatatctcaataaacttaattttagaaaacttctcaggaagataaaggaggaaataatatccatgaaacaagaacaaggcactgaggaacaagaataggcagctgtgaaacagaggtgagggagaagaaatatttgaagtaaaatttacaaaaccttttcagaattggagacatagatcttcatattggcctgttatcactgaaaaccaaggacaattaaaactaaatagataaaaagaatcactgtagtaaaatagcagaacctgaagaataaaaatacatttttcaatatgactgttaacaaagagaggtaatattgacaattttacattaatgttacttagaaaaggaatattttctaagttaagagaaaaagtaactacaatatgcaattatttgttccactaagctgacaataagtagaaaaataacaatacctttttaagtacataaaacaattttactatcaaatggatttttctaaaacaactcctaaagaattcagtttgcctagaagagaaatacaaatagaagtagtgaagttgataccagaagcaagatttggaaaacacacacagatacacacacacacatacacacacacacacacacacacacacacacacacattttattaaataaatgaatatcaagatctcaggatgagtttaggaaagcttggaaaatttgtgattacaagtttggtgactgggcatatttgtatatttttaaactccattcaagatttatttggttcttttcaatgttaaaatatatgaaaactacttcattctccaaaacatgttatttttgatattctaagagaaaattactgaattgtcaatcttatttcccaagtaagattcttttttcttttctttaaagtaatggtgttggttattttcaattacaataatgttgtatggtctagtcattctagaaatatatttttaaaaaggttaaaaacagagcaaattataatcaccttcataaaataaaccacagtgatatatggacaaatataaaaatgtattaactattaactttattactaaaagtttaacggtaaattatataaatttgacattataggaaagaagcagtaatttattataggggtcagcaaacaatggcctatgggctaaatctagcctgcttccaatctcggtcaataaagttttgtcagaacacaatcagattcatttatttttgtattgtccatggctgctttcatactacaatgtatgtcagaactgagtagtttcaacagaaacattctggtttgcaaatcctaaaacatttactatctgttcttttacagacctgtcagcctctgcactgctcatataggcaccataggaacatttgtgatactacagacactttcaactaacttaaaaagagaaaggtgccctttctttttagtagtataggataaaaggaaagaattctctttaacttttgaactggcaatgatagaatttaagagatgcaaccctgaaaactaaaattgtacattggttgaataaaatattttctaaatatgtatttttatacttcaatttaagattgttgctctgactaaatatttttataatattttaatcatgagcattctgctttacaaaaccatttcttaaaaatactcttatacttttgctgtagagtaattttcagtcaggggaaatttggcaacatctgtagacattgttcattggcataattctagtggaggaagaaaaacatgctactggcatctagagcaaaaggtcagttgctctgctaaacattacaatgcataggacggaccacacaaccaagaactcttcaccccaaaatgtcaatagttctgaggttgataaattttcctatagagatatggtaaaacaaaagaaagcaaagtaaagcagaacagaacaacaacaacaaaaaaaacacaaactaattagatttcaagataaaaaagattatttcagaattcccatctccaggccagcttttattgtgtatacaccaattgcagcatctttctgaagaaaaataaggaggctctttacagcagacatcatgtaataaacagtatacactcacaaggatcataagtttgggaactttttaggaagttcctaaaaataatttccctgcaaggaaaatttgctgttagtatgttgatattgttttctgtagaattcagtgttaaggtgtcactttttcaaggactctttttttaacatggccttgttgctatttcatcttttttgaaaccactctatgatcacatgacaaggcagtttcaaagtttttgcatgttaatgcagtgtgtctttgactaaggaagaaagataagagtgtcccacaatataacttgttaactaatagttacatgcagtttttaaatatttttgtttgtttgatcttacaatttccagtaccaaaaattttcacaaaaattagaattatgacatggtctaatctccctaattctgttcatgttattcctcaatttttgcaaaccttttctctaaaaaataaatgtaataacatttcttcctaaagtcattattatttatctaccttaacatttgtaatgaccataaactatttaacattttcttttctttccttctttgtatgtgtgtgtgtgtgcatgtgtgtgtgtgtgtgtgtgtgtgtgtgtgtgtgcttttagagacctagtcttgctctgttgcccaggctggagtgcagtggaaggatcatagctcactgcagttttgaagtcctcgtctcaagggatccttccactttaacatgtcataacacttcttgattagcattaagtactgcagcatttcttgttgcaatgtcaattatttattcatatgttaaagagctgataaaaatcaatacaaagttacatttttttgtggcgattgttgatatatattcattaaacaaattcatatatttccctaaagttttcctatatgatgtatgtttgaacaggattttgcaactatcattaaaaagaatgcagtatttcaacagtaatattgattctttgttaaaaatttagacacaattgtattacataaagattaaacaacttagaatttttgaaaatgcatacacattttatatactactcttttttaaaaaaaaattttcattccattccaggggtacatgtgcaggtttgttatataggtaaactcgtgtcacaggggtttgttgtacagattatttcatcacccagatattaagcctagtacccaagagttatttttttctgctccccttcctccttgtaccctctaccctcaggtgggacccagtgtgtgttgttctcctctttgagtccacgtgttctcgtcatctagctcccacttataagtgagaacattcacgtaccactcataatctatccttttacttcaagaaaaattatgaaaagttagcataaaatttgtgtacatcattgttcttgtatttctgtatcttattccattattttcatttggcaagatatttttcatcatttttatagttcataccaaaatatactaattttttacatatatgttaaattatattttcctagttttactttatgttaaatttaactttatgactaatccttatgatgtgtagaaatttattttttatggtcaattgtagaaatcttaggctttataatttttacttgtgcatacaaaaattttcttctctgtcaagattatatatattggccttattttcttttgcatctattatagataatctgaattaattttcacaataattataagttaggtgtttttcttaaagaaaacactggctttaaagaaaagttccattatgtatgaattcaaatgattttctcaaatatacactttcaattcgcttattctctcaatttcccatggaaacagcaaggttcataaaatatagaaaaccatctcactattatgcctaattcatcagacttcaaaaacatacctgaaggtcagcgctctgaaatacataggtaggtacacagtgtcctacataatttcatgaaatgcctcattgtatttaccgataataaaaattttcctcaaaaaaatttaaaaaataaagtttgttatataaaaataggtgcagtgaggggagtgtctgatttctccaaactttgtctaaactagagataagagagtatttgtactaatgagataagtgcagacgataaagaatagcatagtctgagacgtataagaaataacaaaacctggcagagacacagcaaaaaaagaaaacttcaggccagtatttttgatgcacattgatgcaagtatccttaaaaaatacttgaaaaccaaatctagcagcacatcaaaaagttaattcaacatgatcaagcaggcttcatccctgggatgcaaggttggttcaacatacacaaatcaataaatgtgattcatcacgtaaacagaactaaagacaaaaaccacacgattatcttaacagatgcagaaatccaacatccctaaatgttaaaaactttcaataaatcaggtattgaaggaatatacttcaaaatagtaagagtcatctatgacaaacccacagccaacattatatatactgaatgggcaaaagctggaaacattccccttgaaagccagcacaaaaatgccctctcttaccacttctattcaacatagtattgaaagtcctagccagaaaaataaggcaagagaaagaaataaagggaatccaaatagtaaaagagaaagtcaaactatctctgtttgcagacaacatgattctatatctagaaaaccccatagtctccacccaaaagctcattgaactgataagcaacttcagaaaagtttcaggatacaaaatcgatgtacaaaagtcattagcattcctgtacaccaacaacagacaaaccaagaaccatatcagataggcaatcccattcacagttggcacaaaaggaataaaatacctgggaatacagcaaaccagggagatgaaagatctctgtttacaatgagaattacaaaaggctgttcaaataaatctgagaagacacaaatggaaaaacctcccatgctcatggatagtaagaatcaatatcattaaaatggttatactacccaaagcaatttacagatgtaatactatgactatcaaactaccaatggcattcttcccaaaactattaaattggctatagtacccaaagcaatttacagatttaatactatgactatcaaactaccaatggcattttttcacaaaactattataaaattcacatggaaccaaaaaaaaaaaaaaaaaaagagctccaatcctaagcaaaaagaacaaaactggaagcattctattacctgactttatactacaaggcaacagtaaccaaaacagcatggtactagtgcaaaaacaggcacatagaccaatggaaacacattcttatttgttcttttattcaaaacaatattaattgaatgacttcaaagtatcaggccttcttagagactacatttattagcagaattctattcatcatcaggatttttttttttaggattaagctcttcttcacttttgacatttatcattatcttattcttttccttattaattctggaatttctaaaatatattattagtcaaatctgatgtttcctagaagtctacaaaaatatttttaatggccaatattttgttcaatctacttagtaaaaatgttcatatctttaattcagtggaaagtacatttttaaatagaagcttagaggaaaaataatagactgagtctacagattatagaacctaaagtttaaaagtattcaagaatatgtggaaacccattaacttttaaatattcaataatactgctattatggaaaaaatttggttttctcatttaatgatggttgagtggaattatcctgtatctggcttagagtgaggaaagcaattatcccatttttactgtaatttttcctctgcccctaatttattagagagagaaagagatctgaactgggaagatttaagatttttcatctgaaaaaaatagaagattgttatagatgaattctaaactgttatctttaatattctatatgtttatgctatgtttaataattaatatcagtattaataatactggtaacacaatttttagtatataattcacattctttcatttaaaacaatacttactatgtctttctttctgccagatacttttctgagtagctattaactggattttcatagatgaatgattttcatttggttgcagacaaatgaattattctctataaattgcataactgtcaatggtaaaactcagtattctgacaataaattcatgcaatatgcaaatgcattaataattgacttaatggttgtgaataatgcaaatattttacctttaagtacattcattaatagtaaaacaatagtaaattggaaataggtattgaagtaggtacttagttttagagatgaaattaataatttatataatcaaaatgactaatttggttggctaggaaaggtcaatgaccacctaagttctcacattttctgggttattactggaacatattttctctggacttagagctcattaaagatgcatagtctaaagttctgacattcaatattttttctctgattcagagaactagtttacagcgttctttttattttttcttttttgaagcagatgaaaaaagaattcttggtctttaaagaacatcagagagccttttcaaacaaacacgagtataatcattaataattaagctgtatagagaaatctcatgtattcaaaattctgacaccaaatttgacttaagaatttaaagggattctcacaatcttattactataattgatgcacagagggtactcattatgtctactaaatctgaaccagatcctgatgtctaaaaatacttgtcaaattgcatgttatataagccatcattgtaattaactcatttattcaacaaatcttatgaaatatcgactatacacttttgctgagcatcaaggctaccatacttgggaataaaaaagacatagtctcttttctcaaggaattgacagtctaatgaaatattcatagactaatcaaacagtcacaagtaatgtcaaatattaactacatagattataaaatgaatgtacaaggtattatacatcagaataaaaaaaggaataaaatattctcaaagtaaatttaaagcttagaaaaccaaaaatatctaccagtttttatttttaaaatttataattttctatttatttcttataaatattttaaaattatcagaagtattacatttattatctcaatatggattcaacatttagttcatcctgctttcaaaaaaacaaatgtcatatcttagctattgtgaataatgttgcaatgagcatgggtaaatagctgtttaacacactgatttcatttcttttggacatatacccacgagtgggattgctggatcacatagtaatgctgtttttaagtttctgaggaacctccatactgttggtcataatggctgtaccaatttacatttctaccaacagtgtgcaagggtttccttttctccatatcctcatcaacacgtatcttttgtcctttttttttttttttttttttttttttgagacggagtttccctctgtcgccaggttggagtgcagtggcgtggatctcggctcactgcaacctctgcctcccgggttcaagcaattctcctgcctcagcctcccaagtagttgggactacaggtgcacaccaccacgcccagctatttttttattattatttttaatagagaaggggtttcaccatgttagccaggatggtctccctctcttgacctcgtgatccgtccacctccgcctcccaaagtgctgggattacaggcgtgagccaccatgcccagccttttttaaatcatactttagtctggaatatatgtgcagaatgtacaggtttgttacataggtatacatgtgctggaaaccatcattctcagcaaactgacacaggaacagaaaaccaaacaccgcatgttctcactcataagtgggaattgaaaaatgagaacacatggacacagggagggaaacatcacacactggggcctgtaggttggggtgggggtcgggggctaggggagggatagcattaggagaaatacctaatgtagatgacagattgtcgttttaataaccattcaaacaggtgtgtggtgataccttactttggttttgatgtatactacctgattttagtatgttgaacattttttatacacctgttgccatttgtgtgtcttcttttgagaaatgtgtattcagatcctttgcgtaaattttttttctgttgatttatttgactttcttatgtattttggatgttatcttcttatcagatgtgtggtttgcagttattttctcccattccctagattgtctctttattgaagccttccttttctgtgcagaaacgttttagttttatgtaatcccatttgtctattttcagtttcatttcatgcaatctcatctatttttgcttttgttgcttgtgttttttgatgccatatccgagaaatatcactatccagaccaaagtcagaagtgttttttttctgtttatttcttagtagtttcacagtttcagatcttacatttaagtcttaaattcattttgagttgatttttatacgatgtgaggtggtaatatcaatttatagatgaatgaagaaaatgtggtacataatggaatactagtttttttaaaaagagaaaatactgccattttgacaacatggattaacttggaggacattatacaaagtggaataatagacacagacaaaaccatatgatttcacttacatgtatagtataaaaaaattgaactcatagaaacagaaaatagaatggtggttgccacaagctgggaggtaggggaaaatggggagatgttggtcaaatgatataaagtttgagttgtgtagattaaataagttcaaaagatctaatacgtggcatgatggttatagttgataatactgtattgtatacttgaaatttgctaagagtatataacttacatgttgttaccacaaatatgcatataaaaggtaactatatacagtgatggatatattaatttgcttaattgtggtaatcattttattgtatatgtatatcaaaacataacattatataccttaaatagatacaatacaattctttaaaattatacctcaataaagttgggaagaaaagaaaaagaaatcatacaaattaaaaaaaaaaaaaacaccaagcattcaaagtacaaattagtgcaatatatatataactgtgtgtgtgcaagaaatctggtttcacaaatgtaagagaaatcctaaatacatggctttctatattatttcaaaaatttttatctcttttcaagctataggtggcttttcattatgatattctatataaggaggaaagaagacttatgcacaattattctctgatgagatagtggtttagtttaccttatctcactaataaactgtagacaaacaaatggaacaaagtatactatctctctgtattctttcttgtatacaggaaagaaaaattgacaccctgggagcagacatgtatttaaaacctgtatttgacagtgactaggtgcatgattctgagaaagtttacaaacagtgcctctgctggtaaaaattgcaaaataaatggtagttactcttattgtcatcattaaaattatcatcagtatcatcattgatgttaataataagcaatgtttacttcagcaaatctggataaaatgcagaattgataagaatgggcacttaattcgcatttcttactacaacagtgcaggggatatgtcctaggcactacacatttatctaatatttaacaatggaatatattatttaaattggctatttacacatattttatgctttacaccagtccacctaaggcttgaagttggtgagaagtatttaatactagattaaaatcatgtattaaaagaaaacatgtagggaaattacaaagcatttgatcctgtgcatgattaaggataacaccaatttgattctaatatatatatatttttaagacagagtctcactctattgcccaggctggaatgtagtgccatgattttggctcgctgaaacctccacctccacagttcacatgattctcctgcctcagcctcccaagcagctgggattacaggtgtccaccaccatgcccagctaatgttttgagtttttaatagagacagggtttcaccatgttggccaggctggtcttgaactcctgacctcaggtgatccacctgcctcagcatcccaaagtgctgggattacaggcatgagccactccacccggccttaattctaatctttcaagatatttttaaaaatacacttcagtgtaacccttatttttttaagctaggactaaaagaaaaaaaaaaattcctaccaaaaatgcaataacgcattttagaaaccagtatttgtcaacatctctcaatacggagtgagagtatacatcaaaacaaaatttagtataatacattttataaagtcaacacatgattcaataataaacatctatctgttaaactgacactctctaagtgtaaatttaattctctatattgaaaagaatgggtttcttgccattaatttatctatttgatgacttaatgtgtattaaacaaatagttgttgaagacattctaggtgtcaagcatggtattatatatcacacacacaaataaatataagaattgtatccttttgcaagaaattcactgtccagtgaaaggagagttaaataagaaaataaacataatgcaatactggaaagaatgaaggaatcacttggtagcacaatatgcttacacctaagaaaaatggaagtagaagaaaaagctgtctgaagagtgatatctgaaagaagtctcaagtgatttatttggaaaactatttctaaaaactagaatttagttaagaattataaagaaaattataacatatggtaagaattttgcataaaaatgtaatttacaaaagcggtatcttaagagcaataaaaaataaattatcttccttttccagccataatgttataatagagaccagatttaaccttctgctctaaacaactagaaaactgaccagtacaactaaaacaagggttttatgttttggacaacagactagaaatgacagtgaactctttgattaccccatcatactgtctggagaaagtctctggtcttctgcacagattgtgggaacacaaatggaacatggcattctccatgagtagagaagatagatttgagaattcaggaaggccaaaataaatagaattttctgtgtacagtaccagagaaaagtgagttgcagaggtctccagaaatctgcagaggattagccttaagtcttcaactgaacactgatcataataattatgtgaggaaactatggggtttggaaaaaaccaccagaaaagaacagacccaacagaaaactgataagaatggaaagcatatagctgagaaatgtgagcagaggaaagtaagacccatgatggacaagaaggcctaggaaacagagctagtgaaggaagatgaacatgaaaaagagaccagaaattaacatctaaagggaggagaaaaatcagtgagcatagtgccaagacctttccctagtcaaacgtaatagtttaaaatacagcttctctctctgggcagcgcatctctgaaagaaaggcagcagccccagtcagggacttacagataaaattcccatctccctgggacagagcacttaagggaaggggcagctgtgggcagcttcagcagacttaaatgttcctgcctgctgactctgaagagagaagcggatctcccagcacagcgcttgagctctgctaagggtcagactgcctgctcaagtgggtccctgaccccagtgactcctgactgggagacacctcccagcaggggtcgacagacacctcatacaagagagctccagctggcatctggcgggtgcctctttagacgaagcttccagaggaaggaacaggcaacaatctttgttgttctgcagcctccgctggtgatacctaggcgaagagggtctggagtggacctccagcaaactccagcagacatgcagcagaggagactgaatgtgagaaggaaaactaacaaacagaaaggaatagcatcaacatcaacaaaaaggacgcccacacagaaaccccatccaaaggtcaccagcatcaaagactaagggtagacaaatccacaaagatggaaaagaaaaaaaaaaaaaaaaaacagcaaaaaaaggctgaaaatccaaaaaccagaactcctgttctccaaaggatcagaactccttgccaggaaggtcacaaaactgacggagaatgacttagatgaactgacagaagtagccttcggaaggtgggtaataacaaattcttcagagctaaaggagcatattctaacccaatgaaaggaagctaagaaccttgaaaaaaggttagcgggattgctaattagaataaccagtttagagaagaacataaatgacctaatggagctgaaaaacacagcacaagaacttcatgaagcatacacaagtaccaatagctgaatcaatcaagcagaagaaaggatatcacagattgaagaacaacttaatgaaataaagcatgaagacaagattagagaaaaaagaatgaaaaggagccgggcgtggtggctcacgcctgtaatcccagcactttgggaggcggaggtgggggggtcacgaggtcaggagatcaagaccatcctggctaacacggtgaaaccccgtctccactaaaaatacaagaaattagccaggcgtggtggtgggaacctgtggtcccagctactcgtgaggctgaggcaggagaattgcgtgaacccgggaggcggagcttgcagtgagcagagatcctgccactgaactccagcctgggcgacagagtgagactccatttcaaaaaaaaaagaatgaaaaggaacagacaaagcctccaagaaatatggaactatgtggaaagaccaaaacttcgtttaactggtgtacctgaaagtgagggggagaatggaaccaagagaatggaaaacactcttcgggatattatccagaacttcccctggcaagacagtccaacattcaaattcaggaaatacggagaacagcacaaagatactccttgagaagagtaaccccaagtagaataatcctcaaatttcccaaggatgaaatgaaggaaaaaaatgttaagatcagccagagagaaaggttgggttaccccataagggaagcccatcagactaacaatggatgtctctgaagaaaccctacaagccagaagagagtgggggccaatattcaacattcttaaagaaaataatttcaacccagaatttcatatccagccaaactaagcttcacaagtgaaggagaaataaaatccttttcagacaagcaaatgctgagagattttgtcacccccaggcctgccttaccagagctcctgaaggaagcactaaatatagaaaggaacaaccgttaccagccactgcaaaaacataccaaattgtaaaaaccatcgacactatgaagaaactgcatcaactaacaggcaaaataaccagctagcatcataatgacaggatcaaattcacacataacaatattaaccttaaatgtaaatgggctaaatgcctcaattgaaagatacagactggaaaattggataaagagtgaagacccatgggtgtgcggtattcaggagaactgtctcacgtgtataggctcaaaataaagagatggagaaatatttaccgagcaaattgaaagcaaaaaaaagcagggattgcaatcctaatctctgataaaatagactttaaaccaacaaagatcaaaaaagacaaataagggcattatgtcatgctaaagggatcaatgcaactagaagagctaactatgctaaatatatgtatacacccaatacaggagcaccagatccataaagcaagttcttagagacctaaaaagagacttagactcccatacaataatggtgggagattttaacaccccaatggcaatattagatcaacaagacagaaaattaacaaggatattcatgacttgaactcagctctggaccaagcagacctaacagacatctacagaactctccaccccagatcaacagaatatacattcttctcactcccacatcacacttattctaaaattgaccatataattagaagtgaaacactcctcagcaagtggaaaacaacgaatatcacaacaaacagtctctcagaccacagtgcaatcaaattagaactcaggattaagaaactcactcaaaaccacacaactacatggaaactgaacaaattgctcctgaatgacacactagttaaataacaaaattaaggcagaaataaagaagttatttgaaaccaatgagaacaaagacacaatgtaccagcatctctgggacactccttagtgtttagagggaaatttataccactaaatggccacaggagaaagcagaaaagatctaaaatcaataccctaacatcacaattaaaagaactagaaagtaagagcaaacaaattcaaaaaccagcagaagacaagaaataactaagatcagagcagaactgaaggaatttgagacacgaaaaacctttcaaaaaatcaatgaatccaggagctgttgtttttgaaaatattaacaaaatagatatatcactagccagactaataaagaagaaaaaacagaagaatcaaatagacacaataaaaaatagtaaaggggatatcaccactgatcccacagaaatacaaactaccatcagagaatgctataaacgtctctatgcaaataaactataaaatctagaagaaagggataaatccaggacacatacaccctcccaagactaaaccaggaagaagtcaaatccctgaatagaccaataacaagttctgaaattgaggcagtaattaatagcctacaacgaaaaaatgcccaggatcagatcgattcacaggtaaattctaccagaggttcaaagaggagctggtgccattccttctgaaactattgcaaacaatagaaaaagagggactcctccctaactcatattatgaggccagcatcatcctgatatcaaaatctggcagacacaacaacaacaacaacaaaatttcatcaggccaatatccctgatgaacatcaatgcaaaaatcctcaagaaaataccggcaaactgaatccagcagcacatcaaaaagcttatccacccagttggcttcatccctgggatgcaaggctggttcaacatatgcaaatcaaaaaacataatccatcacataaacagaaccaataacaaaaactgcatgattatttaaatagatgaagaaaagacctacgataaaattcaacaccacttcatggtaaaaactctcaataaactaggtattgatggaacgtatctcaaaataataagagctatttatgacaaacccacagccaatatcatagtgaatgggcaaaagctggacgcattccctttgaaaaccagtaaaagacaaagatggtctctctcaccaagttctggccagggcaatcaggcaagagaaagaaataaagggcattcaaatagggagagaggaagtcaaattgtctgtgtcaaatttgcaaatcaagtcaaattgcagatgacatgattgtatatttagaaaaccccattgtctcagcccaaaatctccttaagctgattagcaaatttggcaaatactcaggatacaaaatcaatgtgcaaaaatcacaagcattcctataccccaataacagacagagagccaaatcatgagtgaactcccattcacaattgctacaaagataataaaatacctaggaatccaacttacaaggtatgtgaaggacctcttcaaggagaagtacaaaccactgctcaaggaaataagagaggatgtaaacaaatggaaaaacattccatgctcatagacagaaagaataaatattgtgaaaatggccataatgcccaaagtaatttatagattcaatgctgtccctgtaaagctactgttgactttctttacaaaattagaaaaaaaactactttaaatttcatatggaaccaaaatagagcctgtatagccaagacaatcctaagaaaaatgaacaaagatggaggcatcatgctacctgacttcaaactatgctacaaggctaccattaccaaaacagcatgggactggcaccaaaacagacatacagaccaatggaacagaatagaggcctcagcaataacaccacacatctacaaccatctgatctttgacaaacctggcaaaaacaagcaatggggaaaggattccctatttaataaatggtattgggaaaactggctaggcatatgcagaaagctgaaactggatcctttccttacaccttatacaaaaatttactccaaatggattaaagacttaaacgtaagtcctaaagccataaaaaccctagaagaaaacctaggcaatcaataccattcagcacataggtatgggcaaagacttcatgactaaaacaccaaaaacaatgacaacaaaagccaaaatttgcaaatgggatctaattaaactaaagagcttcagcacagcaaaagaaactatcatcagagtgaacaggtaacctacaaaatgggagaaaagttttccattcaatccatctgacaaaaggctaaaattcagagtctacaagaaacttaaacaaatttacaagaaaaaatcaatcccgtcaaaaagtgggcaaaggatatgagcagacacttctcaaaagaagacatttatgcaggcaacaaacatatgaaaaaaaagctcatcatcagtggtcattagaggaatgcaaatcaaaaccacaatgagatgccatctcacgccagttagaatggcgatcattaaaaagtcaggaaacaacagatgctggcgaagttgtggagaaacaggaatgcttttacactgttggtgggcgtgtaaattagttcaatcattgtggaagacagtgtggcaattcctcaaggatctagaaccagaaataccatttgacccagcaattccattactggttatatactcaaaggattataaataattctactataaagacacatacacatgtatgtttattgcaggactattcacaatagcaaagacttgaaaccaacccaaatgcccatcaatgatagactggacaaagaaaatgtggcacatatataccacggaatactatgcagccataaaaaaggatgagttcatgtcctttgcaggggcatggatgaagctggaaaccatcattctcagcaaactaacacaggaacggaaaatcaaacaccacatgttctcactcataagtgggagttgaacaatgggaacacagggacacagggagacgaacatcacacaccagggcctattggtgggtgggggcaaggggagggatatcattaggagaaatacctaatgtagatgacaggttgatggttgcagcaaaccaccacagcacttgtatacctatgtaataaaactgtacgttctgcacctgtatcctagaacttaaactattacaaaaatcaattagttaaaaaaatattttcagttaagctgtggttgaatacaagaaccaaccacttccccatgtaatattgataagcatggaatgcatgaatcatagagtctcagggtaagaagatttgctccaaagctaccttgagtcaattaatgggattcagctggaaacaaagaaaaacctcgagggagaagtaccagttctaataaaatgctcacagttaaaacaaaaataaacaaaaactgatatattcatttcttatgtttttaaagttcaaccaaacataaaattgggggcataattcctgtggggttaataaaataagtacatttcttcagccagttgatgaaaaatatgtaatttcatttacagcccctgttggttttaaaaacgaagtgtttttcaagtatacacaatgatacttatatgccttcaggtataaatattaaatgatctaaaagaacacaattttgctttattgatttcagctgtcaaaatgataaaatacaactttatttccttctattacagaaagctggtcaggctttttagagagtgatagaggcactagtatcaaaagaagagagaaagtacatagagaagataaaaatgcatccaatgtctaaccaaaatggtaaactacttagggaaacttcacccagaataagagtgtgattgaaaatcaaacagaaaagtatagcacctagtcataatcttaaatcaaaagagttattcttatcatctgatgtttccaaattatacacagaattttatccacatgaaaatatggattgaattttcatgtcttgtttcttcaggattaaaatcctttttagaaagtaaaacatgaaattttcaaagaaaagggaaaataaagagcatgttaaaaaaagaagacattattggaatacaaaagttaatgtggtttctacacttgaagtttcttagaattgaaaacatagaaaggaggggttagatattgcataacctcaagttgttaaagcaggatgaggagtaaggctcttaggaaggaagagacagcttcatggcagaagcaaggagtccagggaaggtggtaagaactgcctcagagcatcagcgagctagtgaaacattaaaacgtataaatagcaattaataagatctagagaagcattggaagcccctggctaaagtatggtcaggtacacagaaccacaacagaggcaagaatgtgaccatgtttagaaatcaaatgtcagaatatggtaaattagtcagcagtaagtgaagaagtcaaaggtatggtacatagtattaaaattcaggacaagcaccaagtttaggtttcaagtactctaagcttaaggaactagacaggtagtaaatgagttgtgacagcagtttataaactaaagagagtatatggaattaaatttaaaaactgaaaatttggggacaggctaacatttaggtggcactgtgacagcaatttatatagataaattcatataatcctcaaaatgactgcacaaaattagtggtagccctatattatagatgagcaaactgaggctatgtcatagaacttttctaaagacaaagagctagtaagttatagaatggaaattctgagatttattcaccttccaagcttctgtcatattaccaggcactgaaattgaacaactgaagacctttaaaaatcttggaaaatgcataaggactttgagctaacatttgctttagtgtggtagcatttacatcatccttgactagccagtgaaaaacctgtagtaagtgatctgagaacagtgagagttcgccaaaatcatgtaagcaacattgtgacttggcgatcagtgcgtttcctacttgttctttggaagtaacttccacaatccatctttttggagaatgagactcatttgtaatgaatatatgcccaaccccaggtttttagaacgttaaagaagtgaagtgactttaaaagtcctaagtattcttcagatgagaaaattgagattaagacaggttaatatacttaaaattttaaaaataacatctgtccagggccagagggggaaaaataccaaacgaacatgttgagagtgtctttgttcacttgttcccacttagatatttatggggaaaggtctttagaagactgaagaatatcaacacatctatggtgctatgtatatttattcatgaaatttttgtctgaatcacaaaaatcttgtatttcttttaagctttcaaacaaaataattttatttaaaaatagtttcttatttaagaaaattactaaattatgaagaatataagcaattgtttttcatgatgtatcagccttgtgcttaatttgccattaggaggaaacaataatctctaagaaagctaatttagtattgtagctttttaaaatggattggattatattcccccagtgacatgttaaagtctcaacttccaataactcagaatgtgatgttatttataaatagagttattagagatgtaattagttaaggtgagattgagactgaatccattatgactggtgttcttctaaaaaggtgatgtgaagacacacggggagaatacatgtaacgggaggcagacattggagtgatgcagctacaagtcaagaaacatcaaagcttgaccaccaccaaggaagctaggagggggcatggagggattctcccctgtaggtttctgaggaagcatgaccctgctgatactgttttttagtacagctagactccagaattgtgagacaataaatctctgctgttttgagacaatcagtttctggtattttattgtggcagacctagaagactaatatgttacattgttcatcaaaatatattcactattccagcattggtgtcacaattaagacttagagtaaatataatcaaatgtcatgtcttcaacatccaccatcctctttaaatattttattttatagttctgtattttctaatcattacctctgctctctctctcaatcgttcaaattatatttaagtctttccactccattttgactttgttacataaaaatgcaccctacacacacacactcacacacacacacagacatatgcatagagtatttcagttaaaaatcactatgatcagggcattcatagcttatgttattaaatattatagttaagtagagttcctcaattcaacgtgaagatacaaatcaatttccaagaatgagtatagatgcacaacactaaacatatattttagaatcaacacgacttatcaactcttggcagatgcagaaatcagaggttctttctgtgcctcagggttgtaataaggaatgtcattatacacttatcagagtttcgctttataatagagctgttgttagagacagttttatagctgataaaaatttctgataagcctacttgtagcgtgtctaaaaattggtttgcattattttcctttatttgtccttagagggtggcttaagatgcttctctctgcttcacaaaattgattatcaaaataaaaataatccaatgcatcagaaaattacattgactcaaccttcaaaacatatccagaatctgaccatttctcaagctttcatgctgacagactagactgagccatggccatttctagcctggattagggcattagcctcttaactattctccctttgtgtattcctgcccaaacctcacacacactgatctgttctccatagtatagccagagtggtcactcaaataatttcacttctctgcttaaacccctggaataagtctttatttccactcagaatacaaaacaaggtcttaaaattgcctaaaattatcagaatctcctctcccccattatatatgtgacttcatcctccacaagtctctaccttgcttgcctgctcttccacactgtcgcccctgatgatcccagaaaatgtcaatacatgcctacattaacacagtactggctttttgctctgtgggcttttcttctcccctatagctacacagctagctctcatcctcttcaagttgtcttcgtcaaagagatcaatcctgatggtagaatgtaacagtgttgtcactcactcttcaacccagaacttgtgacaccccacacttgttctacttctactttttcttttatcacattctctttctctctctctttgtgtgtgtgtgtgtgtgtgtgtggtgtgtgtgtgtgttttatgcttagtgtttattatctgtctctctccactagaagttaagctccagagggcataaaatttctgtcttgttttcttgtttagcaatgtatcactaactatggagtccaggacatggtgtattcacaataaaatatgctgctagtgaaacatggttattatggaagaacacattttatgataatcactattacacttaggcgataacactgttgaggggtttaagtaatatcttaattactgacattaaataccatttcaaaatattgctgattgatgcctattaaagtgacaacttgtcatactgcaccacatgcttcaagtataaatagatttgggaggcaacagaaatatcttttcattaattttctatgtacaagtgacttacattagtaaacagaatttaaaaagtctctggagaagcaagttcttctcctcattcgcagaattaggtatgttggtcctacccatgggcgaaagaatgtgtctcaggtctttattcctgttttgatccctgctcccttgctttaatcaattctgccctggcctttctcaatacctggagtgagagatgctcttcactagaagacccagctaagatctgccctagcaggaaagtcactgaaggcctgaaggacaaaaatgataagcagaacttcacttccttcctcaaacagtatattggaaggaaaaatccatgatatctggatttcacacactcaaattccaatgccaactcactggaacctgagccaagatagtctttgcctttatatcatctggaaagttgtatagagaccaaatcttcaaccccagatcattctcatgtatgaagcaggtattaaataaatgccagttactattataattatccttgaaaccaggaatttttgtcctcatttcaatgatttctaaagatgcccactgagtatctgtgttgtttcttggtcaaaccatttcctccttataaatgtcctccacaagccttattatcactggaccaggtcacagacagggttattggcttaggtcctctgcttagaacatgaaaatgcccattctcattcatattctcagtgtagaactgatattaagtcctgaaattctgctgtactgaatctttgctcaagaacagacagctctttcctacgtgaatcctgctttctggacatctggaatcaagcactatactggccggttactttgaaataagctatgatctcttacctttacatctctcactagctgcctggagtcttgtggtatcaaatcattgacctgttcaaagtcactcttagccatcattaagttgataatttattgggattactgtatattgagccacccaacttcttccttaggaaccaggcacattatatttatttatttttttaagtcccagggtgttttccattcctagacttcaacatttttatagcttatgttgctctgttcatagaagctttcatagctaagccttcttaacctatattaacttgataaatctttgtgacaatttttaagatagatgacatacagcctttctgggatctccattcttacagcaaagctttggataaagtattatgtctattaacatataactcctcctgaaaaagcccaaatactgctgagggaagctaacagaaacaacaaatgaccaaagtcaaggtgacattgagttatgcacaatattctataggagaaggataaagggaaaaattaaatcttcaaggtttttttcacagaagtcttccaataggcagtggcatttgaattgggccttaggacaggaattctgatagactgggcaataaagggcattcatgagaagggactatgagcactgaagtgcagagttgtgcaactgtatgacaggactgaggaatagtgaatcataaaacaggttagaaatgagtggtagagaatgactttagatgatgcaatcaaggttgaatatactagttggaatgcttaggattttaaaccttttctcataaaaaagaataactcttgtaaattttaaaatagaggaaagaaaataatatgtttatgtgtatattattttttaaacctctgaaaataatgtggaaggcggaatagaaagactagagactagaaattgtccatttagagagaactgcattatttcaagagagatcatacaagccaaaactggagttgtaataaacagacataaaaagctgaatgagagaattcctaaatataattcatagtatttttgataaagtttaccctgaagtttagaaatccagatggatgtaaatttcatatgagagatgaatcagggaaaaggaaatatgggtagggagagagatgaagatttttggtattgggaagattacaattttatctcaagtttaaagtattgagagacttacaggtgaaacacaataaatagtacaaaataagaaagtatatatctctgcagatatttgaagctatgagtgaaagtgcaaagacaaattgcggaataaaggaataagaattgactaaagaattaaagatgagtggaaagagaggaggaagagagaaagagagtgatgggaaacatctaagagcaaatgttggaggattctaacatttaagtggtcagcatgtgaagaggagtctgtgcataaaactggggtggtagagtagggaaggaaattacaaaatagtggcaccatggaccgagctacatacaaaatgttctgggctgagttgaaaatgaaaatcagaaccatttgttcaaaaaagtagagaaaatgtaccgttacaggtaattagatataaagtttttcctttgttttatggtctttatctaatcattttatggtattttatttgctgtttaatgtcattctatgtaagaaaaattttcaaatattggcataaatactaccatttatctttatgttgcataatgccagctttaatgacaaatataatttaagaattaaacatcaaaattacataattcatatttcatggttcatacgtgcatgttattcttatcacaacagtggaaacactgaagccagtggcttgtataatgcccttacgttgtactcgagtctcactgagctattacatactgtggctccaccaaaagtcaagtccttctgaggtcacacacccctgaagcccacactggatagatctaagggcttcacgaagggcagataatgagtgtctaccactgtctatgtctttatgatagggcgccatcagagtggtagagaagacagggacattgtaacttgagatagaacaataggattaagtaggtctgaaatctgaacttttctgagtccatttatggctgatactaaaaacttggccagaaaagtaaaataaaccaaactgagaattgtcaaaatttacccatatcgttatatcagatgctggcaagttttcctgtaaagaagaacatagtaagtattctgggcttgctatgtgtgacacaacctctgtcacaactattcaactttgttgtcattgtacaaaattagtcatagataatatgtaaaccagtggtctccaacccctgggccatggattggtacctgtctgtggcctgttaggaactgggctgcatagcaggaggtgagcctcctatcagatcaacagccacattagattctcattggaggtgaaccccgttgtgaactgcacatgtgagggatctaggttgcatgcttctgatgagaatctaactaatgcctggtgatctgaagtagagcagtttcatcccaaaaccatcccctagccccccatggaaaaactgtcttccacgaaactggtccctggtgccagaaattttggggactgctgatgtacatgaattggtatagttatagctgtgttccagtaaaattgtctttccaaaaacaaggaatgggtcagatttggcctgcaggctatagtttgccaatccttggtctttttttttttttttgcttgctatttttccaaggtcatgtaccactgagatgggtattcagcaatgaaaatgaaagtatttcaaaaccaaagaactgtagaatgcacaaaaaagtttgtattattaaactatcacaatcactctactgtattctctatagaatgtcaataacactattccatgcagtgactagtgggaatgaaatgcaaataatgaatgatctggaatagtacaaactagcacaacacaaaagcacggggctttcatttgttaggaaggtgctagcagatgtacaggaaagaaaatgccaggattttacttctgatcttattgctcctgtgtgttgggtttcagcagatacagttggccctgtaggaacaccagcagcattcattgctgggttagttccaaatgaggttaattgtatatattttaagtaagttagaacaaaagtgacattatatattgttacaaaagattctgtcttccatgcaaatacttccttggccacaggaaaagggttctgagtgacttttaatgtagtaaagtaacttggagaggtatggttggaagtgtctacatcttacttgtagggtggacatcttctttggtgtttaatagttttaatcagaaggaaaactttttccttatttgttggtttataaaatgtaaatataggaatgaggagtttgaaaaccctgggacataaacattattcaaaaaaaaccctaggatataaacatatgattcaaaatacgtagaaaagaaaaatgatgttattgtgttaaagagttacagctcatatttgaacacttcagggcccaaataagcaagcaggcaaacaaacaaacaatcatagtggtgactggtgcctgtcacaaagtagaccatcaatgaacacttgaatattgaataaaatgatgtgattaggccaggcacagtagctcacgcctgttatcccaacactttgggaggccaaggtgggcttatcacctgaggttaggagttcaagaccagcttgaccaacatggagaaaccccatctctactaaaaatacaaaattagccaggcgtggtgacagatgcctgttatcccagctactcaggaggctgaggcaggagaattgcttgaacctgggaggcagaggttgcagtgagtcgagattgcaccatcgcactccagcctgggcaacaagaatgagattctgcctcaaaaaaaaaaatgtgattaattccactcaatttttcttctaatttcactaaaacgtaaataatactgtagaaatgtgattaatgattttaacataaacataataatttcattaaaaatatgtagatggcatgtttggacataaaatatatctctgtgttccatgcaagatatatattatacttttttcaattgatttcctgtcaactattataatgctatgacttacaataattttctatatgaatatatttctcaaaattcttgtagtttattttaatctaacatgaataaaatgatcaaatatgctttttgaaatattcttaatatctcaataaaacacatatttgcaaaaacatattttgttctgataaaaagtatatagtaatatgtaaagcatgtaaaaaataaaagtaaatattaaaaacaacattaaggttctggaagaattaggttgcatatgtgtggtgtgcatgtatacatgtatttagaataggttgtatacatggttttacattttctcctataggaagagagaaacaattttccatgtcagtatttaataaagccaccatattatgataatagttgttttccaatttttaaaattttaatataatatttaatatatcagtaataattttctaaaattgaaattatattttaatgcttttaaattttttattaacaaataatcctccagaaagatggtgacaacttactctcccaccaatagagtgcctccactgtgactttcctaattcagaccactacaattggaaaaaaaaagactaacaaataggtagttaaaatttgtatcacattttgaatttgatactctgagttgctcttaataatttttgaatatattttactgcatatagtttttatttgcaaattgttttactgttctagtggtcagcattttgccatcaatttaaaagaacacttaataatcatatgtctgtcttgtaaggtaaaacatggctgcatatattttctttaacgatgcttaagatcattttttggcttagaaaggtattacttttagttaatgtactataaaatgtactcactatcaacatttaatttataattttctaattttgctttcacagttaaaaattttcaattttgagattaaataaatactattatttgacccagcaatatcgttactggatatatactcaaaataaaatagttttactaaaaagacacatacatttgcatgttcattactgcactattcataacagcaaagacacggaaccaacccaggtgtcagtcaatgatggactgtataaaaggtggtgcgtatacatcattgaatactacacagccataaaaagaacaaaatcatgtccttggcagcaatagggatacagattgaggcccttatcctaagtgaattaccacaggaataggaaaccaaatactagatgttctcatgtgtaagtaggagctaaacagtgagtacctatggacataaacataggaccagcagacactttggactagtagaagttggggagggagcaggtaggggttgaaatacctacctattggatactatgctcactacttggatgatgggatctgtaccttaaacctcagcatcacacaatacaccatgtaacgaacctgcacacatacccactgtatctaaaataaatgttgaaacttttattcagatcatttaatgttttgttttgcaattctatgtggttattcctaacacaatttattttggcctgaaacgtagagaacgagttttcaaaataaaacaatgcatcaacagaattcagtaaataatctttctctatggactcacaatcaccccttggatgtagttttatatatagcatgtatatctagactttctattctatttccttttatcagcattttctggagcaatataacattttaactacagtttttatgtgttacaaaaacatacacattctcttattgccctttctattcaacactttcttggttatacttttgcactttcaaataatataagttctaagtattatcttatttggccttgtttggaatttctttatacttttcaaatattgtatgtaacattaacagcctacatttctgagtgctcaaattaatatatcacatgtccatttatatacttttatggttagtaaattttaccttttaaattgttctgtatggttttaataagcagtagtttgaactttttgttgcttaatgctatgatttggatatttgtgtctactctaaaattcatgttgaagctcaatcaccagtgctgcagtattaaaaagtagggtcgttaggaggtgtttagaccatgaagtattctctcttctggatgtaattagtgtctgataacagtgcttgatggggtgagttcagcccttttggcatttcttccacatgaggacacctcattctggtgaagaatgaggaaacagacactcattgaacttgctggaaccttgatctagaacttaccagtctccaaaactgagaaataaatacccattctgtggtattttgtaatatcagcacaaatagactaagacacttaatgcattttttccatattttctaaattatatgtaagaaatacatgtacatgtatacataaggcattttgaactgttaatgagtttaatgaaactatctcttctgtttcagcattaagacactgaatattgttgtgagctatttctatattggtatgattaggaaatattaatagatgccaaaaagatttgaagatgtaaatcttttcagaaagaaaaaacaagagataaaatgaacacatttaataaaatatcaattgagtgttaaagtctttttatttaatgatgcagtaaattacgttattaaatatcttaccttgacttatcctttttattcttggaggaaatgcccctttgtcatttaatagaattttatctgcagtgtacatttttaaatttagaagttacaactaaaagtggaataaacataactcaaacactctatttttcctatccattgctatttgagaatatttggttcatgaagctctgattgctctttcttatatccttcccaaataaccagtagaaaaaatagagttatattgctgtaggaaaagaatgacaaattgctagaatatgttccctttttctcttacattttatttcctttgtatgttaaattaaatcacacaaagtcatgcagtttcaaagacgtcagagaaaaggactttgattcaatttaatagagctgtcaccgtaatacagggctagcaatcatgcacttcaaaaagtacacaaaactcaaagaatcatgctgatagaggtggctccacgatgcctcactttgttaatcgcaagaggttgctcagagtgtcatttttttttctagtggtccaatacaaagtgggaaagtcaccagcagcaagggactctaaaattataggcttgctaccttagctacttttctattatggaaataccacatatggtggaaatgatagcactcagtggtctactttggaagcagacaactcccttcatcatttacacatttgttctatattttggcagtgtcacggaaaccattatgtgtaagaaacaggtatatataatggttcaatctttcaagatttttgcattgtagaacattagactatggcctactatatcatttctctacatgaagagattagaccagagtttttataaagattatttccagtaatatgttttagtgactttatacaaccactattaagcagctattttaatgccatttagtgttagatgttaggtgtacaagagtgaacaacacagaaatcatatttatgtaatgcttagttgtttaacctggtgctggctatcattttaggtatctgcacgttcctggaacccaatctttcatggataccaaacaatgactactatggcaacatctgcatctaaattgtgtaaaacaattttaaaagaagaaaatactatagtaaccaagacagtttggaattgggtaaaagaaagacatatggattaattgaaaaaactaagactccagaagctgacccgcatgtataccattgattgatttttgacaaggtgtaaaagtaatttcatggataaggaataagcttttaaacacaaggctctggaacaattgtatcaccaagtttttctattttcctttccttcattgccagataattttaagatggagtctggaaagaagattaattagactagatggtatttgtcagttgagaagttagaaataagttaatttgctcaacaaataagatggttatcatattcatgctaagaaagatcagaaaaaaattcaaataatcactgtgatgaaaattttaggaagccaattcaaaattaactaggattgcctagaagaattaagagcctaggtgaggaattccataagaattttagtggaacaagccattattatgaattttgacaaaatacaagctggaaattgacaaatgtaggactctaatacatcaacatttgctcttcccgatcttctttccacccttgtttattctaccctctaaacactagagatcaattcaaaggactggctttagcctccagctactgaacagctttggttaataagaagcacctgcagaagactagaagacaacaggaaaggggttgtctagtattttctagtctcctccctgtctgttcttattggattacctgtgtcctacttccaaaggccacaccttctgtaacctagaagctttccattttaggttctggtccttctcttacctctgtctctttaggcccaatgctggttttgctgttattggtctcttgagaactgtaaggtccttagttttccttaaactctacccatattttaataagtaattaccatattaaactctccccaaatacccagttagactgtttattcgctgatgtgactctgatcaacacagtggatgaacatattggaaaatgtcaacaaatgccttgcaaatgatttattataatgactaaatgactagaaaggcaagaaaaactggaaggagattaggagatgtaggtgaggtcaaaataaagaatagttgcaatgggaatgaagaatgggaaaagtgaaaagcagcaagattatgtttaaaaagaccaaattttaggttttatttactaataatgaagaatttgtgccctgattatttccaagaggtggctatgggatgaattgtttgagagacgttttaactctgctacatttaccaagaaccttatatgtgagaaatgatgtattaggcattgtatgtgagttataacagataaaccacaagctatcagcctgtaaaagtacaaggacaataccacatttaaatttgtaattaattttatcatggttttaagaaattttgtagacaaaattatatcatattgaatatatgatataccaaatagaatgacttgttctttcatgttactgaattttcagccataaattacacacctaaaaccttttaaacgttggggtaatatatgaagcaaaaacacacaaccatacatacacagacacaaaccactataagtttattgtcaaaggaaaattaatttcactgccacaaagtaacacttgaaaattccacaagatagaatttcttaaaataatgaaaaatcttatctttctggtaaacacaattctttaacctttttccttttttacatccttaccaatttgatagcaattacaaggggagaatagtgatttaaaatacgctttaaagtaagaactgttatatgagaaaactggcttgtcattaatatatcaaggctctgaattcaaattcacagatattatctccttcaatttttgcatagtgcttttgttaaataaaatacttgaaattaacttatattctgaattatataaaatgaaacaaaaaactttaaatttaaaaatgatataccatgccatagaggataggaaatctcaagaaagttccagtgatttcctctttcccatattaaaaaaaatgctaccactgaagataccgttagaaagagtatgttatattgtgttcaacctgacaaagaagctatttcaagaaatgagaataataaaagttatttctaaactttgagagatctgtcataatgaattgaactagttcagtttctgattgcttgacagcagtatagctgtctccaacctactactgtattgatctggtagcctttgtggcagtgcataaagaataaccatctgtgtcaggtacaacagcaggtgccttctcaattgaactggctgctgccctgattacaatgaggctgttcagagcacccggtgaccatgacaggctctttcttctctgtagaaaagaaactcatttctaaaagtttactgaacagaaactgagaaactcaccagaaatcatcagccgttgaggtgccagaatggattccagtgaagacaaagtaagagatctagtgaagggaagatgccggcttgcagtgggaaattcctgatattgcacactaggctgaagttcccatttggaccattctgaagaagtcttgacctcttttttaagagaggtcatataatctgtaaaatatggccaatctggcctaattacagacatggaggaagacgtctgtattgaaagtgctggagttgctgaaactgtataaaatgcaacattggtggtgacttctgaaaaatcaggcactgagcctgtcaatggtggcagattatttttgaagtcatttgcatgtgtaatttctgaatatgtctttaaagtaacatccggataaatttgtaagtttaactcaaaatccagagaactatcacttgggtgaagtttgaacagtgtatgagatcctttacttttttccatgtccaataagctctcttgatttagtacctcagtgggtcccatagttatgccatattgtcttattttcaatagttttaaaatgttttctgatactgacagttcatcagtagtcatttttgaagtcaaatcagaattcatcaagtctgaagagatagtttgtgaagggacaatggataaacaagtcttatccaaacataaattaacatccaaattacttgatagggtaatggattcttccaaggatgaggataaaattgttctttttgcactctttttagaaggaaataaagatggcacttctgtgaatgccactgatggtgttatttcagtagcagaagaaaatgaatgcccagaagtgatagtttgagctcccattagtgcataccagctggctaatatcgctgagttcatccagaatgtctcataaaagtgggactgtttgctatgcaaaacttgatctgagaattcacgagaggattttatttcagtcatagaacatgttgcacatgtttggcttaattctcttaaagaatcagcagcctgtgatttgatgtttgtgagtctctggttgcttgaagcctcagtaatagcctgatattcactgggattgaaggcttttgtactgaaccggtgcagagctgatgagtttaagatggttacctgtttagatataattaccttagcaggaaaaatgggagacatcgaggggctgagcaatctccagtgctctcttcttgaaattaaagaatcagctgaatattcttcaatatcctcttgagcccccctagagacaactggagttgcacttatggaggcagctataagcaggaatccacgggagagtaatgactgcctgtttagctcaatatcagcccctggaatgcttctaattactgaagtcgttggggtagcagataaagcaacagtctgacagttctcaaataataaagattgtgtaggaaaaataaaatctgacattaaggaagacatgataaatggggtccttgctctcctatcaggaaaaaagaaacctagtgtggctgctgaagttcgaataggcatatgtgataccgatgttttgtcctggacaatttgtgctgggtcacgaataccaaaattcaggaatcgagaagaggaaacatctgcggaagaaagaagactgtgttttgctgaaagctctctagtgacaatcagttcttggagtaagtagctttccaagggtgtgctaattcttaatgttgccaaaccagtggttgggagaatgtcgtgcttgacaatgcctgtctgttttggacctacaaaaaggaaaaaagccaaaaaggttagaaaaatgaatcagaaacgaaccactttggcactgggataaatctcaggcaaattgcactggcaccttacatccattatatgtagacaaatatggttctgtaaatcatatttctaataaaagtacatgaggagtttaatgatttcacaaactgcataaatgcaaagattcctattatttacactccatgggagggctaaagttagaacaaatggcattacatagaattgacatattcccaactaaatgactcctttgaataagaacacatgaaaaattacaactctttgtcattgacacaaccaatgaatgtttgacccatcgggttagaaatgttagaaataccgttttacttcctcaataggcaaaatgttctgtttatattagataacaccatatttcaatttaattttttaaaagaatagaaattacatagatgaaaaatagacaaggtacatttctacttagaatacccaatagccttcaaaattattttttcttcaagaattccttgctaagggctacaattcttactctgattatccgaagtggcattggctacatgaagagtaaatttggaatttaatatacaatgtactgtttataatatgacatcacttgatttagaaagttaaagaattggacatgtaaaaaacagcctgaagttgttaaaataattcacaataggaaaataagcacatatcttttatctgagtgttagtcaaataatttgataggaatataaatttaccttaatgactcagagaatatgaagtaaagacacattgatgcaagtagcacaaggcccttttaaaacaaaatgtgctgggattgaggtccagttgtctattcgaatttacacagtggaataaaaactgttaatttacatttttttactgatccagaaatagtattagcaaacaacattgtttaaaacaaaacttaaaacaggagtcataaccaataatgcttaattttacacccctaaaaatcatgtatctcagaaaaaaaaaagattttaataatgcagaaaatatgcttttaccacacaactttttcaaactcaaacttcttaatatcttacccacttctacttaccttgatcaactgggtaagtgtccattatggctggtattctagtagcctttatagatggaaagctgctgaccaaagtctcagaagggggaattgtatatgtctgtgtggaaatgggatctgttctttgaaagatgggagttaaacaggtaattctccttatttcatcaccacaaagaagcccaatggagcaggtctgcaaatgacaattacagtaattaaattaagctcagtttctttgttcctaagagaaattgtaaagtttgttttgagatccatttgcatttccatagacatattggatagctcaaataaaatattttacttgaaaattaaatctccatagtaaattttacccatatttcaaaatggactcaatcctttcaatttgagatatgcacagttgcatgcccaaatttattcttaattcctttaattttaagtcaaaatactatttttacttttgagaatatagttttccaatgaagaatttgtactgtatggtaattaatgtggatataaaaaagaagtcacattacaaattataaaacttttctgctctaaaagtcaaatttagttggaagctaatgtaaaatgcagtatctgcaacagaaaatttgaaaacatattcttgtgatttgcaaattattttagtttgtattggcttgcagtaggaatgatctttatgtgttttagtttgacatgaaaaggctatttctaccatatcctataaaatagctttcacatgaagaaactgtgaatgaaaattgcgataatgtataaataagtataaatggaccagagagatacgtttataaatgtagagttaaaaacaagttatactatatgaatcatttttatttgtaagaaaataatatttcaaaatgattttaaaatactaatacatgtctatttcctaataataaagacatacctaataggcatccctgctttagtgttctaatatttgttaaatattacatctaatttgcagaacacttaagtcttctttcagatgtgggtggtggttgtttcacagttccatattctgtagtcactttcaactcacaccaaaaagttgtataaatgtcagatgattcctaatgttagataattcgcaacaaagaaaagcccaggaccaggtggctttactgctgaaattgatcatacttttaggaaagaactaacaccaagtctttgctattgtgaatagtgctgcaataaacatacgtgtgcatgtgtctttatagcagcatgatttataatcctttgggtatatactcagtaatgggatggctgggtcaaatggtatttctagttcgcaacccaaatgtccaacaatgatagactggattaagaaaatgtggcacatagacaccatggaatacaatgcagccataaaaaaggatgagttcatgtcctttgtagggacatggatgaagctggaaaccatcattctcagcaaactatcgcaaggacaaaaaaccaaacactgcatgttcttactcacaggtgggaattgaacgatgagaacacatggacacaggaaggggaacatcgcacaccggggactgttgtggggtggggggagggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaatttaaaaaattatataaaaaaaagaaaagaactaacaccaattcttctcaagctattacaaaacattgaagaggaggaaattcttccttactcattctatgaggccagcattaccctgacaccaaaactagacaagaacataaaaaaatccacaggcaactatcattgatgaacctagatgcaaaagttctccccaaaacactagcaaactgaatacaacaacatatcaaaaaataatacactatgatcaagtgggatttatcccaggcatgcaaggatgtttcaacatatgtaaatcaataaatgtgacatatcaatcaacaatatcaaggacaaaatccatataagtatctcaatagatgcagaaattaatttgataaaattgaatatcacttcataataaaaagtctcaacaaatttggcattaaaaaatactttaacataatgaaggtcataaatgacaaacccacacctgaaatcatattaaatgggcaaaagctgaaaccctttcctctaagaactgtaataagacaggatgcccactttcaccattgttattcaccattgtcccggaagtgccaacaagagcaattaggaatgagagagaaataaagagcattaaaattagaaaaaaggaagtcaaactgaccctctttgcagaagacataatcttatatatagaaaaacctaaagactccaccacaaaatctcttagagctgatgaacaaattcagtgaaattgtagaataaaaaaatcaacatacaaaatttagcattgtttccatacaccaataatgaactatttgaaaaagaaattaaaaatgcaatcccagtcacaatagcctcacaaaagaaatacataggaataaatttaaccaaggaggtgaaaaatctgcaaggaaaactacaaaacactgatgcaagacattgaagaggacagaaatgaagggaaagacatcccatggttatggagcagaagaattaatattatttcaatgactgtattaaaccattctgcattgctataaagaaatatctgagactgggtatttcataaagaaagtaggtttaattggctctcagttctgcaggctttagaggaagcatggtgctggcatctgcttggcttctaagaatgcctcagatagtttacagtcataacagaagacgaagagggaggaggcacatcacatgacaaaagcaggagcaacaaagagagagagagccagggaggggatgggtaggggacacacactttaaaataaccagatctcacaggaactcaccaactactgcaacaccagcagaaagtgatgagggatccacctccatgacccaaattcctccccccaggccacatctccagcactggggattgcaatttaacatgagatttgggcagggtcaaatattcaaactttatgaatgaccatgctattcaaagcaatctacagattcaaagaaatctctatcaaaagaccaatgatatttttcagagagataggaaaaacaattctgaatttatatggaatcacaaaagattctgaatagccaaagcaatcctaagtaaaaagaacaaagctggaagcatcatactctctgactttaaattatactatgtagctacagtaacttaaagcagcatggcattggtatgaaaacagacacatagaccaatggaacagaatagagaagaaagagatagattcacatattcacagctagctgatttttgatagagataccaaacgttagagaaagaatgctatcttcaataaatagcgcagggaaaactggatactcatatgaagaaaaataaaactagactcgtatctctcaccatatacaaaaatcaactcaaaattgattacagacttaagcataagaccccaagctataaaactactagaagaaaacagagtaaatgcctcaggacattggtataggcaaagatttttatgagtatgatctcaaaagcacaagaaacaaaaaacaaaaatagacaaatggaattgagttaaactaaggagcttctgcatagaaaaggaaacaattgacagagtgaacagataacctgcagaatgagaaaaaatgttttcacacaatgcatccaacagggaactaatatttaaaattttacaaggacctcaaacaactcaacaacaataaaaaatataaccccatcaaaaaaagtggacaaggggcatgaataggcatttttttcaaaagaagacatacaaatggccaagaaacgtatgaaaagctgctcaatgtcactaatcatcagagaaaggccaattaaaactgcaatgagatattatcttacattagttagaatggctaccattaaaaagacaaaaaataacagatattggcaaggatgcagagaaaagggaacccttatatgcttctggtaggaatgtaaactaggacaaactctatggaaaacagtatggagatttctcaaagaactaaaaatagaactacgattcaattcagcagtcccactactgggtatacagccaaaggaaaataaatcattatatcaaaaagatacatgtatttatatgtttatcacagcaccgttcacaatagcaaagatgtggaatccacctatcagtgaaggctggatcaagaaaatggtggtatatatacacaatggaatactagtcagccataaaaagaattaaatcaggtgttttgtagcaatgtggatggaactggaggtcattttccaacatgaaacaacccagacacagaaagacaaatacccacatgttctcagttacaagtgggagctaaataatgtgtacatatggacatagagtggagaaaaataaaaactggagacttaaaagggtgggggaggacatgggggggtaaataatgagaaattacttgtggttacaatgtctgttattggagtgatggatatactaaaatcccagatttcatcattatgccatatagacagtcacgtaacaaaattgcacttgtaacgcttaatttgatacaaattttttaaaagctaaaagagaattttaatgttcacaacacaaaaaagatatcttcaatattatgctaattaccctgattttatcactaacacaatgtatacatccattgaaatattactatgtattccataaatatgtacaattaatatgcgtcaactaaaaataaaagaacaaaagaactataaagtgtctgtgtataaaaacttaaacattaagtggaaaaatatccacagcaaacaaaaacacagggtcaacaggatcccttaccataatggatacagaatgcatgtaaattaagaaaaaagagaaggggccaggcgtggtggctcacgcctgtaatcccagcactttgggaggcccaggtgggcggatcacaaggtcaggagatcgagaccatccttgctaacacggtgaaaccccgtccctactaaaaatacaaaaaaattagccggccttggtggcgggcgtctgtagtcccagctactcgggaggctgaggcaggagaatggcgtgaacctgcgaggcggagcttgcagtgagccaagattgcgccactgcactccaggctgggcgacagtgcgagactccgtctcaaaaacaaacaaacaaacaaacaaaaacctaataggtaccaagatgatatagtaatttctatgaaacatcatgacttaaaaaattattttctttctgaatctatgtttgaggaaaaatatgcaaataagatcttctgaattagagctttatgagaatatggtcatctgctttcttgtggacattgtatagccctctatgtcttcactcaacaaatgtttattgatcaatatctaagtgccagtaactgttgtaattgttggaaatgagctggtcaacaagataggcaaagtttctccattatatactttgtattttaggaaagaaatttgaattaattaatatcaattagtgataagtgattttaagacaaaatatcccaaaatacataataaggaaaaacagcaagggctgttttggaggcagtggccagggaagtcttctctgaacagggatataaattaatgtgagtattttaggaaagagtatcaaaggcgaaaagaacagcagtgcaaaggcctgcgggcaggaaaatgcttaatatatttacacaaaagcaagatggacagttaaagagaataagggaaggccatgtaggtagaaatgaggtcacagaggtgattagaaaccagataatgtggcttctttacttgtttgttgttgaatttggaattgattctgagaattataggaagccattggaatatttgaaataagaaagttctaatcttattgatatcataaaaagcttactgtagataatatacactcaatggagcttggattcgggggaagaatggaagctaaggtatatttgggaagcagggactgatccaggaaagggaaataattagactgacctggagtggaaatggtgaatatactgagtaaagtttgtattcagggtatacgtggaaggcagagcctataatacatgctgatggactagatgtatggggtgagaataaaaagtttagtgaatgatttgtaaatttgtattcctatcaataaaatagaaataaaaattaaagaagacaagcaaatttactaaattatagaagaccagttacagattggaggatagatcacaatttctgtttaaatacattaaatttgagaagcttattggctaccagatatgtaacaagttgaaaatatgagtctctcttgaagcagaattattaatagtttcaataaaataaagtatggtttaaagaaaagcagtgttatcccatagtcctgtctaattttctggtaatagagctagaaaatggcagagcaaagatttttacctaagaagtgaggctccagaacccacacttcaaaccactatactatacttttgatatatgaaacatcgtcaagatttgttatcaatatttctaagctaaagttgattattttaggtaataaagctaaaacaatcttgtactctgacagtctacttaacaaacatcactgtcaattaaatttaatcatcacaaaccatgttttaagatctgggcaaaacagtttctattatctcaatgactttacaatccagtggactgttagtatatttcactctattgacagtaacatttgaagataaaatgttgtggcttatccttattttctacaagaaataaggagtacataatacagaaaaaacccagcatccttcaggtgacttgttcctctttcctgtgtctttccagcctactttgagtggtttcatgccattgctgacctctgtttacctcactaacctctggttattttcagctctcttttttttcaactgtatgtccaattctctctatggtttctgttttcctcattaagatattaacagattctgtgttctataaaagatacataggatatttctctatgtggttatctaacttgattgggagacaaaaggcaaagtaggtggcaaccagaaagtgagaataatattctgaagatatcatttacccataataataaaaaaactctagtaataatcaaatatcaaatgttaagaatactttgctccaaaacatgtaatattgagatatctttgtgctatgttactgggctagataaatattttagtttctaggtttttaaaaagatttttccacacaaaatcagtatgtagggttcatgataataattatagtttttaacagcattccttttgttatgccaaattgatttgtatgtcttttccagcatactaccagtgcccctaggaaggggactatgttacattttccactgaatggccggggctaatatgatggctggcacatactgatgtacttgatggtcagtaaacatttattggaaaaaactaagagaaacatattgaaaacacacgtttatctaagtacatacatatttctttttcccttttgtagataactgtattgaaatgaatattcattaaattatctaaacttttcattctttcctcaagccattctaatgtagctttcatgtcttcttgccactaggactgttatagtgaaattccagaaatcctattgtgctgttaaatacaaagcacagtttttgatcttcatcttattcaaatcatctacatacttaactaccaccttctaaaaaacttggtttctctctaaccttctacctctttctcctattcattatcaatctcctctgctggctccttctctttgtagcctctagtttggaatttatcatggcttagtattcaacttttttctttctccattctccccagaagcaatgtcatatattcaaaaaggctataaagatatcatatattgatgagtcccaaaatcatatctctacttcacacttctctgaaatacatttttatataaccaactgcttatttagaatcattatttaaatatctcatgggtaccttaaacataacatgtacagtactgaactgctgattcagtctctccattctaacatgttcctccaaccacctgtcccatcacaggaaatttattatcattactctattgctgaagtcctccctgatttttcattatcttctatctcacacatctactcaatacaatgtcttgctaatttttctttcataacacatttcaaatccagccttttctctgaatttgctttgccacaaatatcaaaccatcattatcttttacataataattgttagagcctagctggtttcttcactcccacttttaacctccttctagatctttctttatggaagaataggaatattttaagaacctgaataagatcacatcatttcccttttgaaaaaacttgttagtatatatgtcaattgcacttgaataaaattcaaactaattactatttttctgactctcaacctaacctgaccctgtttacttctacaggcacttctgtacttttgcccccaccatagttactgtgctcaactcccattatccactctttactgtcccatacaggacaagatcttttcctcctcatgacccttgtttatgctgatacatctgacagcacatccataccctcactcttcctttggattatttctttttatcacacgggttataacttaaaggtcccttccttagagaaaacttttctactatctacattatttttctatcacagtaactttttcttttccttctgactactatagtttgaattatattttatttttctattgccttgatttatatgtcattcctggtacattgtaaatgtcactaggtagaagcctatctccattccatcctgcattgtattcagcacactatttgtatgctgctaaccaattagtgtttgttgaatgaatataaaattatatttacaaaattgcctctataaattaggttaaagagttgagcaagcaaaatgtaagtatttttacccataactcgtttaattaaaatttgaaacacaggatggccctttagatgcctttatattacaagaaaaacaaccaaccaaatatgagagttcaataggcaccagtcttgagctacaagagtcatcaaccttactctgagaaataagggccacatcatgtgaacagtctgtcttgaaaccagagatgacagatgaaatggaagtgcaattagcactattacactctttctctttgtcctctacacttaagaaacattttccccttttcccaaggtctatcattaagaaatgcttaatgctgctgaagatgagctcaaaagaattggtaaattatttgaaaatttagcaatttgaaaactaagtaagctcaaagccatttaccactatcccatttaaacatgcatcaagaaacattttcccccttttccgagatctttcattaagaaatgtttaatgctgccaaacaggagctcaaaataagtggtaaattatttgaaaatttagcaattggaaaacaaagtaatctcaaagccatttacaaccaccctacctaaacatgtgtcaggtagctcctaggctttagggactaataaaaacagagccctgggtgagtttttctggttgcttagcaagtcactagaggaaaaatgcaagctggtagaagaataggtcctattgcctcttgtgttgggtggacttcctgaggagctatacaaggctaggacattagaatatgtaatatcatggatgctaatcttccacaagatagtgcctccaggttcaaacactgccctacctggtagctctggccctttttgggataactattttaaaccaggaaagatttataggaaaaaaagtgcttacaggacaaaataattagccccatttagcttttctttttcttctgtttcctcctcttcccccacttctactccatcctccttctcttctttcttatcctactgctgctcctcttcctttttcttcttcatttcaagagcataatcccacagagattttgtttccctgagactgatacataatgagttgaagcggaaagagtgaaattagagatcaggagaccccaaagtgcctggaaaacctctgttgcctcccaagagcacacagaacttcgcccttcttgaaaaaatccattagacaggaaatcattcagaattttagaggagtctggtgaagtctctcttagatttccaaaccctgcaggctgtttatcaaaatcttatacagcctcatacaaaccctgtgatctacaaagatgttatctaagactccagaaaggaaagccctttcatgtagttttctatatgtgatagggctcacagaagtagatggtcatcattcaaactggttctgtggaggtgagtcagtggtcagatctgaagaagtaagtgtgatctatgcatgtcttccgaacagagtctatcttaatggattatatagatagtactacagatcacatgaattatccctctgcttaggctgtgtatactactaaagtaaatgaatacctgtgtgtgtgtgtgtgtgtgtgtgtgtgtgtgtgtgtgtgtgttctctgcctgaagcatctaccaaaaaggtggccaagctctcaagaatatatataatgctggtattcttttcttcccttatgacaacttgacaacacacaacaggaattctcattcccctaatctgcattatttctctctttttttatttttgggtggaacatgttccatcaaatttatgtgcttcgctctctgtatctctgtctctttctcttggtttagaataattcatctataatggctcctgagagtcattgcctgggacactgcaacgtaacattgttttatttattttcctaggttatccacaatatcctgtcatgaaagtttaaaatgtcttttcctaggggaggatgataatcatgttttctgtctgataacctaacaatgtatggcccaaacttttcaaaacattttcaagtatgtcagtcaattaattgttaattcaaatcagttttcatctttctcaaggttaaagaggagaataaaatcaaagaccatgaataaaactatgggtccataattttataaatttgtatgaagtctgaagaacatcaagaatttgtgaaattttccacagagtagaagcacacaagctccatctaagttttatggggtgacaacaatataaacatgaaatagtcacttcttctctggtgtctgataattggtagtgaaaactttaaggataattttctttttccttattgaatttggctaccagaacttcaggggatttgcttcaatggcaatgcttctgaaagcacaagttcattgatttgctgtataattttaatctgcagggagatcttctagcagactaaagaatgcaggaataaggatcttaaggaatgcactgaatctcacttttgtttctagtctatccaaaagaaggtgcaataagaagggaaatggaaagcatagctcaggggagaagtcaaggttaatactagagacagatgcgcaggcaacaaatattgctgcagaaagttgatgaggcaagaggtcaagatgcattgttttagaggcaaggtctcaaaagcacattgactatgtatcaaacatatgccagagttatctttcaaaataaaagtctgaccaggtgattcctcagttcaaaaagtcatgactggcttaccactcttcttgaaaacagtaaaacaatttaatctagcacacaatatcaccagctatttcttattgaatattgatttttcttattgaaaacatggtgagaaacttacttaggttacccccaaattttaaatatatgggattttctcgacttttcacaatgattaagtttaattacatgtcaattattttcgatatccatgatcctaatataagaagtgccaatggccttcttatacactaactacatttgtagatattgagttttaaaagcaaaaaaagtttgaatgttaaagttatatgcctgactacggccaagttcatattggaaataccattgtttttaatttaaatttaagtactttgtatttaactccaaatagcaaaatcaagaaattactctgtgtcagtcatcatatcagaacaatttaataacgcataattactacaggtgcaaattatcagtgtgactaatatatatagttatatataacataactaaaactctgtggtcctactgtcaatagcatcctctgaattttttttttctaaattctcacctaattgaaatcaaataccttaaagatttccctgagaccactgtttatgactcaccagtcctagaaactgatatctgatacagaaccctgagtatgtacaagtaaaagagccatgaaacatttcagaagtcaaattgtttgatctttcctactattttggtaagaatacatggaattagcagacactataggtaaattcgtgggtcatcgatgtgaggatcccaatactcaactgatttttgagaactggcaagtagaaatttaaaactttctttttcttaccaccaaatatctataacatttagggaagcttttcttaagtcacagaatgttcaactgactgctcataagaaaagacatttatttcatgaaacatcttacgttcctccattggaaataatgtcctcattctctgaatctgtataatgttatgtgtttacattttatgctgcttacccatttcttttctgtgttataattgttgttttgcatgttgtatctcttctctacgaatctgagtttcttaggataaaaaaaatcttaaatagttgttagaatctaagttcaacaatatacacatattaagtgctaaaatatgtgtcataaaggatatattaaaaaataacataacctcacatctttccattcacactccttgaaagtaacttgcaagctttcctacctgttctccctagaacaatgtctccttgtattcaagaagacttgctacacttgacctcctatatagactattacttgagccaatctgagcaaacaaatttggactgcatacctttattttgccatccatagcatcttgtttttatacctctatcaacacatattagttaatatattatcatttgtttacccatttctcccttggagtattattctataccaacccaaacagccacagttgtcacacaccaatgaatacactgatcattttatacttatctttaactaatttatcattagaaacattaagttggcatcttcattttagaacattaagaacaatgtcttctgaacactttcaagcctctctcattttctacaacatactgtggcaatacatattttctttctcctttcagattgaagtgagtcagccttatagtcagaaagtctttgaagctagtcttcaaactctgggaatgtgcacacagccttctccttacttgggaattcaagtgcaaatgacatgaaaacagttacagaaagtaaggcaaaaccaaatcaaacactatcatacaaggacaccatctaacatccaaaatatatcaaaagcagcaagcaagatatgctgtgttgtacgtcagtatccctgagctgcatggagagcaacaaccaacaggtcttccttcctacgcattaactcttttcttagtttcatttatttttaattaaggggggaaaagcttaaagcaggtggtttctgtatgaataaaaaaaaagactcctaagccaaaagagaagtataaaaccctgccgtttctcagtggcaatgccagaaaaagcagagaaacagagattggtttttatcataaaaaacgcaatagatgcaagttatattttctcccactgccttgccagaatttaattatttctagaataagctagcaggtgtaaaatgcacagttccatttgttatcatgtaagaaccatgtgaagaaaagaagttttggttaaaaaaaaaaaagaaaaaattgaaggcactaagtcttagtctgttcaggctactgcaaaaaaagataccataaactggttgacttataaataacagaaatttatttctcatagatcaggaggctgggaagtacaagttgagggatgtttagtgtcggctttctcacagatggtgccttctaactatgtcctcataggctggaagggactatctagttatctgcagcttttttataagagcactcatcccaatcatgagtacttcaccctcatgactgaatcacctcccaaaagccctacattctaataccatagtcttaggggttagaacttcaacatttggatttgggtgagggagatacaaacactcaggccataacagaatagataagctaatctttatataagttaatgtattctgtgctcaccaaaagaaatctgagtatggctcagagtgaaaagatctagaactgtattttggttgcagagtgaaaactttctgacgtagtgctcatggatatagggtttgtattcactggacaaactacattctaacatttgctatctatgaataagcgaccaacatctctgagcctgtttcctcatcatcaccataggaataaataatgattcttacatcacaaaattgttttaatcattcaatagggtaaagtatccaagacatttagcctggcaaatagttaggcttccttcataaataataacgttttaatggaagcttatggctcaagtgatattttaaatcactctaaatattattgtagaaaacaatgcattatatctttagcagtgtatgatattgcattcaacagactgttccacaaaattcttgtgcttagttgtgattaacaccacaataattgtaatccattcatgttttcgttcatgtataataatcaacaaaattttatttagaatctactatgttgtatctgcctggagaacagaagtaggtaatatgtgcacagttcctgttttatggaacttattgaagaggagaaaagcagaccagagagggagaagggaatagagaagaagaggaagggaggtgagagtagttggtcaaataataaatatatagccacaaaaataattgatgaattacaattttagtaattgctatgaagacaaattataaaatgctgcctaatttcttgtgcgaatgcaaaatggtacaaatattttagaaaacagttgggcagtttctaagtaaacatactgttactgtataatccagtgagtgtgtgcctcgatgtatagcaaacgaattgaaaacatgttcacacaaaaaactccacaagaatattgataacagccttattcatgattgccaaaacttgaaaacaatcaagaaaaactttagtaggttgaacggataaaccatggtacatctggacaatggaacattattcagccctgacaggggctctcatgccatgaaaaaatcctggaaggatattaaatccccattattaagtgaaagaagccaatctaaaagggctatatactgtattacttcaactatatggcatccttacaaatgcaaaactatgaagaccctgaaaagatcaatgattgccagagatggaggggacagaggaattcacaggaggatcacagaggatttttagggcattgttactattctgtatctataatggtggttacatgtcattatgcatttgttcagacccaaagaatgtacaagaccaagagtgaactctaatgtgaactacagactttgggtgataatgatgtaatatagatttattgattgtaacaaatgtaccactctgtcatgggatgttgatagtgagggagcctgtgcatgtgtgtagggatgggtatatgagaactctctgtattttctgctcactttttctgtgtacctaaagctcttccagaaaatagtttaagaaaaaaagagttacctaagcacatgttgtggcagtattatgaggtttacctgaaaaagagggacatatgctaaaacctgaaagatgagtagaattgggatagtgggcaggaaggattggagatcattctagttaaagtgtagcatgtgcaaagacacacagccagaattttgaagggaatatttgagcaactgaaggctaaatagggggctacagtacagggttagaagatcaggaggaagtgaggctagagaagttatcaggaaggggtcaaactgcacacagccttgtagactacggcaaagttgtaggacttcggaatggattttggaatccaatctgtttttattttagagagtagcttaataatatctttgtacagacattgtggctcatgcctataatcccagcattttgggaggctgaagcaggacgggtgcttgaggccaggagttccagacaagcctggcaacatagtgagacctcatctctacaaaaaatattataaaaagttagctggttgtgggaacacatgtctgtacttccagctacttggtaggttgaggcaggagaaccatctgagcccagaagtttgacgctgcagtgagctatcatcatgtcactgccctccagcctgggcagcagagaaagagcttgtctaaatatatatatttagttatataatatattaactatatatagacaataatatagttatttatcttaaaaataaatggatattgcatttagttatctatcttaaaaataaatggataacatttatggcatagaggaaagaacactgatctaccattctgtaagtatgggcatttaaaattctgtgcccaactctccaatgggttaacaatgttatcttcaatatagccaagcttttaattcatccacatgttcatgctgtaagtgaagaaacaggctcagagaattttccatctaattgaagtctaaaatgttaagccattacttttttgagtcaatatatgacattaaatatattctaggtttctaccaaatacattcttccaccagccacattaagcaaaaatctgatgcataaagatgaaaggtgggcattcattatctttaatatctacataggtctatgaggtggtcattattttaccatactccatttaccaataaaaactgctgttgtaagaatttttttttttttttttttttttgagtctcactctgtcgcccaggctggagtgcagtggcaagatctcggctcactgccagctccaaatccccggttcaagcgatccttgtgcattggcctctccagtagttgggattactgacagccactaccaagcctggctaatttttgtatttttagtagaaacggggtttcaccatgttggccaggctgatctcaaacttctgacctcaagtgatccaccagccttggctccccaaagtgctggggttacaggcatgagccactgcaacaagcaagttgtaagacatttagattgtacatcacagctgtgccataataaaatgtaaggcaacttattttaaatattctacttctgaaaatattaaactacatttttcattatacattatacttatttaatacagaaaacttcctcttttcattaatatttatgtctttattctagtttgcaccatctcctcccccaaaaccctcacatatcttgcattacaaaatactgtcactgtgttgcttagaaatgctcagaacacacatccctccatctttttcccccccatagcactcattgctgcccataaacaaattaacaaataaataaacacaataattttgtttcttcccccatgcatcctctgctttttaggtggtagatttcataaaagctaggatcttggctctctgttaccagagcctaattgatctggggagaggaaaatacattttttgtgttttttttgttgtttgtggtaaaacttgtcctgagaagcagatcgagccttatttcttatggctattttatatttagcattctcattagcagtactgagcaaaccctcagggtggacttccactatgtggtgcagattaagtttcagcgcttttagagatacctttctaatccttaggaggaagccattatcttttgtccattgagaaatctttcctaacgactactttactcagagttcgccaattgctttattattttttaatattactaccaaataagcgtcctagctaatgcttttatttccctcatcatacagttttcttcattttgtacccaatgctgacttccttattatcccacacattatttgtctcttccatacagctgaatgttctctttggataacaaactgaaactaattgatttttatattattttaaggatctgcaaaaaatggtgctcaacatatattagagaaaactatcaaatttcacccgaataagagcattattgatttttttagtgcattgcaagaggatgtgagcctgtactcttttccttaatttgaatgtaagactagtgtatatgtatttctttataagttttccaaatacattgttttagtgagtatccaaaagatgtgttttgactgatctaaaatacaaattacttgaattcaaataaggataaatgtcaaaaccacaaaaatatctacttaaaagagcattacgagtttgtctaaaatggcatctttgctttatttcctattaggagataataaatattttttaatagaacaagtcatctcaaacacagaaaacacttggtaaatatttattaataatattgatgactttatcacatgagaaaataaagaccagaaacatagacatacatcaaaatgtttgtctgtcttgctatactggtgtcttctgtgttaggtttattttgaagatgacatttaaaaactgaacaccacaaataggctgtccttctgtagaactcagaacccttttttctcagaaaatagtttctccattttttcttcattttaatacaaatacagcttccacactatataaacatctgtgttttaatttaagggctgtaattaacactttcatcgactctatcatttacaaaacacaataagcctgaccaatagacactcatcggttaatgcatggagatcaatcttgtttggcagaatttcatttactgaggaagaaatgagcagttctgatcaaatgaaaaagagaatgatcatttttcttgaattcttaagcaagtttaggacattcaaaaattgtattctgtcatttaaattcttttacagaacatttgaatttcaaaatgatgtaagtactttaatcttgtttggaatcacttttgtaattggatctgcttaaacaaataatattcactaattatcagcttgtcagagattgtcatagctctaaacattaagaaaaacctgagagttcagacttttaatgttatcttcaaaaaattaattctcagaaataaagaaaaaaacagcttcccatctccctacccagcagggactatttacctcccacatcactcttcatcattaaacaagaataactgtagtaatattaatcctatctaatcctgtaaatatgtagctgaattaacatttttatatgatgacctaattagtgaaacttttaaagtagcttaaataaaaggaatctgggaaaaaagtgccatttttctgaagatctctgagaagaaagatattagagggaagttcaggtgaacataaaaggatttaatgtgaagagaattgctacaaattgttaggtaaaagccttattgctttgaattgtgctttgttgtttcatgttcaattaaaaattcaatacaaacatatttcaattatttgaattatttgaatgttctttacacagattgcatgtgctactgtatcagctggtgtagttagagtacacatgcaagacaatttttaatttttaattttttacatgttaatggagaatctgattgccaaattaatgacttttgaacaatcccataaagccttctagtaactctgaaaaacaagacaaccattcaagttgagatacctgagaagcctaattagaacaacaaaatcctttttttaaaagacacattgaattacatgaatgaaagaaaatccattcatgttttcttaataaatatattcataggtcctttcattctaaaacaatcacaaaattctgggttttggtctggtgtgtagagaatttggaagtcatcattcccatctacacaataagagaaaagctgaacaaactaaaaatcaactcttcttagatttttaagaaaattgagatcatttcccactaaaggaaaacttctgcccccaaacattggagagacagtcaggcaggtacaaagaattatagcttaccagagcagaaattcagaagcagaaacctctgctggagccaaaaccagggtagaaaaacaaactgtaattgatgaaatgctggaggctcagtgtgtacgagcttgagagttagttagaaactacaggggagcccactcttagggaatatcccacactgtaatgaactttatgttcaaaaatgctacagggttctcacagtgaggtttggagaaaaatcccctcatgcttccagcatggagaggagagaatagccattttgaagactcccagagcattctgttcctcttaacaaggcttgtcctcaagtgaaactattttaccagagcttagttgacctgcaggaagggaaatacccaactccagccctgtgtagattttctgtctcacctaagggaatggggtacagagaagcacattcgaaggtcacagaccagaggcacagaatcaccaagactgagacctaattataggactgttaaaggcttaccctctccctacaccttactgccatatcaacagggatcttttataacaacaggagattacaactgaaagaactccacacctcacacttctttaagaagaattttctaatgaaaccaaaatacaacaggcaagatgaaaataaaaatataagacgaaattttgacctctgacacctatggctgtagcatagcaaacacagcctgactcctagccagataaacataaaatgttatgctacaggcctatttatctgagttccttttacgcaatgcatcatgtgtttaaatataaaattacaagacacactaaaagccaaaaaaatagaagagacagagtaagcattgaagtcagactcaggtatgacagggagtctgtaattatcagactgggaatttaaaacaactgtgactaatatgctatgagcagtaataaaacaaccttaacaatgatgaccaaaatgaaaacacgtatacagatgctcctcgacttatgatggggttacattacgataaacccatcaaaagttgaaaatattgtaagtggaaaatgcatttaatacacctaatctactgaacatcatagtttggcctagcctaccttaaatttgtccagtacacttacattagccaacagcttgggcaaaatcattcaaccccacacccattttatattacagcgttgaatagatcatgtaacttattgaatgctgtgctaaaagtaaaaagcagaagggttgtagggatgttcaaaataccatttctactgaacgtatgtcactctcgtacaatcataaaatcgaataattgtaaattagtgaccgcctatactgtgctctgtgctcttaggaatactgcaacgtccagtgttgtcttcgtccttcaggagtttacagtgtttcagagttgacagagaaatgagcaaacgttccaacagaatgtgataactgatgcaatgtttagtctcttcccatctattctagtgctagaatgccatgacttaccccctgtacattgtcaactctccattatggacactgttttcatgttcacctacactctatgtacacacttcatttttagtactaatgcaaatcaatttaccttttttctaattcttataactgctttattcttaagactctctcaagtttgatatcttcctgtgaatgaagtacccatgaagtttcacatttccccatggttgtgatttttattcttttaatatcccatttgcactaaagattagtgggggagggaaaaataaacctaaaaagtgattttctaatgtttttatgcattttccatacctgtatccatttcaatattttatttcaatatttacaaatttaacgtgctacaaatattttatcaaatattttgaatatttgattttctgataattcagcagattattttattttctgttccaattaataatttgcgtgttattttcaaaagtatatttcttaggaatatctaatttagagtaaatacatactgctatagcattggcatgaataacatttcaatgttaaaattctttttcaataaactgaatttcccctatctttagctactcattttaaagaataactaatgcattagcaaaagttgaatctcccttatctcattgtagcatttcacacaaacattatctcttgctatgacaagtttttaaattttgtttcagctttcaagtacttagagaatggttgcaaaactatccatttgaaattaatttagtaaatgccttactaaaatgtaaatgcattatgtctataacattttcttctatttagtagacatgtggtcttataaaactatattttccaagatgtttctatttctaacatatactaatgtatttatccttcagatttgatttttttattaaagaaagagctcaaatattaatagattcatatttcacatgtgaaagaacatataccaggagattaactatttcaggaaattttatagatatttggtagtaaattatttgtttttatgaaaacatatcatatgtaaaataagcattgattttctaagttatttagattcctacgtatctaaggctgcactggcagaagacatagttaaataaaagacacatctcagtattttgctctttatactgactcttcgaggaagacattattggtataatctgaggtgtcagaaaaataacttcttggtaccaactaacttccaatttaagtatcagagcatctgatatttttctccaaagatctatcgcttttgtagcagtaagagaaaatctttttcctagggcaaatccaaaattagagaattctcagagaaaggaagatatctgtttgagctcattcatatccctccaaaacagatgagccctgggaatatcctttaagagggaacagcattggacttaagcccaggtccttctacaattgatttttcaaaatcttgtgttccgtgacagttattgattatttttttctatgtaattccttaacctcgtctagagactcttggttctggtttttcctttctgatctttcacttctgagaaggagtttctagctccatttacacttcccttcacacttgttcatcttttatacacactggccagatgcttgaagtatgattctttattctggcactgactctagtcacctgactataccccatctctaattatttagccttaatttcagtgaaggctggtctaataatgatatttataaatatacatttaaaatttctgataacacattcttaccaattgctgttttttcactatattcatgggctgcggtcagttttaataaaagactgtggtcaaatgctattttttaatagagacatttttaccaaggaaagtcatttctagtgctaatggagttcaggccagttcaaacttgctgaggaagcagatccgtcctcctcggacatacaatatgctgagcccaaccctggaagtagtactatgtccttgggcaaaataaaagttccgccaagaccctgacggtattaagtaattcctccactggcatcctccttccaaatgcattaagacattaaaggccaatacattaagtcacttgcaccttggtgtggatcagtttatcagaatgtttttcttctgaaagaaaggactgagggtgcaagtgatgcacggacaacaagggaaagaggaatgccgagaaaagtgtagcgtgcacagagaaggagagatgcgctgaagattaactactccgaccttatttttcaccatataattttctactatttactgtgtatcaaagagaataaaaaattattacaaccacaaccaccagtaatctttaccataaatccaggtgtgcataaacatgtcgagccaggttcattctccatgcagagttcatgaacacatgagttgggaatgcactcaagctcattctcacagtggtgtccagaccatcctgttcaacaaaattacaaagcagatatgcaatttttaatgataataaaaacagttatgctaatagcctatatttattggcttttactatttgaaataattatgctagatgttttgtacaaattacctcagtgtatcttcatgatcagtttatcaggtagctcttattctatctctatttagttcaagagaaaattaaactcagagaaaataaataatttgctctaaaatcacctagttaagtataaatgaaagtgagtacatgtatgatatgtctcagctcttatccgtggtgccatttaacattacatattcaaatgtctttacttattttactttggaataaatacatggaaagcaatagaataaagacacttaataattcccttaatatgaatcttaaattcagaggaaagcacctactatagatctctagatatacaatgttatttgtgatacttgtagtattacagttagtattttacatttagtatttgttatactgtgattctatagaatataagtattgtgtctacgtacatttggccattggctgtaagaattctcattaaacatgacaatctaaaattttccagaccaaaacacagtttgattgtatgtattttgtttggcttttgctagtcaaacattttattatttccatcatcaacctatcaaccaacattgctaagtattccataagctaatatctcagctatgctttactgggtagatattaggaacatttttttgaaaccattgattctttcccatcagataattacttctaatgaatcttaatatgcctaacatgctagccacaacatcatgttaacctaagtatacccttccacatagggacaatgggtctttacaggcagctctcactgctcactgactatgcttactctaatcacaactttttaacttttctttatttttctatgtattgtccaatagcatttaatctgaaccctggctgttgggaaatgtaaaatttaattattgtttatacttaggaagatattctgattgttcttccctgataaattgtaacaaaacaattaaatacatattttgaggtacttagaaatgatttattgaaacacttcattataagaaacaaatagggcctgagtctaaaagacatggcaatgtccacatcaaacttagaaatagcggccaagagactaaatttatcaaatcttcatccaagactctttccactttgcaatgctctttcatgtgctgggctgattctgcagagatctctactgaagaggctgtaaaaggtgatatggaaaaaaacatcttcacagggtttataaaaagccaatatgactttgttgagtctcacaaacatagttgagtctcacaaacatattattgagcataaaaacatattgcataaaaatacaccctgataaatgctcttataaaattcgaatgcatatgaaacttagtaacattgcttagagatgcatacatatataataaaactctaacaaatactaaaggaatgctgatataaaattcagaatagttacttcagggagtgggatgtccctggagggatatagaggtggcgagaattattgctaatattctatttctcagaacacatggtagttatacacatttattacagtgtattttgtattttttatatattgtatcctcttctgatcgaatatttcaaaatataatttaagcaattaaaatgacatagttttcctttgcttctcatactgtgaagaacatgataaagctttaaaccataagatgggaagtgtaaaagaaaaattgcactgggccagttatacagacaaagaagacttcattcaagagtactgcataggagacagatttttacaatagagtagagagcttgtactcaaccccactaaaataaatgggagcaggaacatttttaaaggccaggtgagctaacagaaaagtaccagggggatgtttgggtgggtgggaatttggtcaatttcaataggccacctgtacttgctgtctcttactgaagttaggcttctactctcccaaagagactgggaaataggggcactatttgtctcgttccagggttacatttgttttgttttgtctttcattgttgttgtttttgctgttttgttttgttttgtttttgagacagggtcttgcactggtgcccaggctggagtgcaggggtatgatcacacatcactgcagcctcaacctcctgggttcaagcaatcctctcacctcagcccccggagtacaggattacatttttgaaggaatgactcccaggtccttgggaaacagcctgagagaagatttacatctcaaagagacagagaaataatttacaactacaagttttctaaagtaaatgctctacgaaaagggagatcaggccctatagtcaggaagaagtctgtctaaagcctagtcaaactgagaaaaacattaaggctgtgttggtcaaagacaacaaacaaggatagaaaataaattagtcaagattcattacaagaaacagaaatcactctagttatttaagcaaaacggacctgaataatggaattagatgcttacaaaattatcagaaggaaggaaagctgtaggagtaacaccaagaaccacaggtatgactttctggaagatgtcccctcagtcaggatcaggaagatgagaaatataaaagcactcttaggatttttgagttcaagagcccattgtgctaatccaaggaaggttgaccaccaggcagctgccgtttcaatgcacctacgcactgaaatagtgactctacagtgagatctgctgcaaagatccacatagctccatgacttttttttaccagaagaatctgctaagacacccagaaatggtctccatcagagccttcagattttaggtatgtttcttactggtggaactcaattatatttgcaactccagttttgaaggattctggaagttgtagttttcaatactcttgcctctgcagtacaggaaaccacactacatgggagtggatactgagtgtcaatcatacccattagtatgaagaaacacgtaagatgaataggtgcttattctggtgtgggacaaggtaatgggtaagaaatgagaccagaataagaaaacataaatcaggcaaataaatatttattggattttttaatgttcagaaatgaaatatattttcttttgaatcttatgtaggttttatgttcattcttaataaggtaaccaaatattcagaaaatagtttggtaactgaaaacaaaaaccaaaaattgtcattagcaatctaggaaaagtaatcaaattattatggtgttaaactaatagtattaacctaatgtctgacacataatataaagtaagtaagtgcataaggaataaatgatttaaaataattgtggtgcaaaataaagacaactttaggtgacacattgcaataaaattggagtaaatttttactaatttttttttaaagacaatcttgctctgtcacccaggctggagtgtagtggcatgatcacagttcactgcaaccttaaactcctgggctcaagggagccaacccacccagcctaaaactagagtgatcttaagttgaagactaaaccaaatctttaaatacattgatatattcagctagaaatattgaccagttttaatattaccattctataacataagttataatactttgagtttatgaatgaaaataaatgtcactacttctaagatttatatattttattttcatttcattttccctctctgcccatagtgatttctatctgatgttatgaatataaaataaaaataaacctaaacctaaaataattttgtctaactagttaatacattatttagtaattggataacataaaattattttctcttcttagtctaactctagaatatgtaaaaaaattttacatgtacaccctcatgaaaatacaatagtatacactcttttatctcataataaggatttctttacttttcatggatcttgatttaaaaaaagattattctgtatctcttttgttctaaatgcagccacctcatcatcgacaataattgtggctactggtggcagatattatctatgtttgtttctctgttttcttgccccaaggatagtgcagcatttctgctacaaaatgaacaatactactttaagggcaaaacatgcatttgaagtttgcatcaccagcaatataacaccattgcacccctgctgggtataaaaagtatctgggcacagtgactgtcccagggattgagaacaactctgagtgaatttgtggtacacaaactgttccctatcactttcaatttgctcttcatgggatagctctgatcacttactgggtgttctacattgttagataacactatacatggtactatttcggctaaaaacacactaagtgtgtttctatttctataaaaaacatctgaatacctatattgatacttcattggaaatgagctcaaaaacccatttaattccctatataggtacaggatgaactctgtgattaggactgtcctaaatgatgttcaggatgtttcttgcacaaagaattcatgcaaagaggatgagtgaggtctgaaatctaacctgagctccacttgtcaagtcttataccttgttggcttggaggaagtggcatatttatataatttttctgcctagagatggtggagggctttatgcttaccatggccctgtcatgactggacaacattggccatcataaatgaattgtactttttcaatatgtgctgaacactccccaaggactgattatgatacaaactctctactaggatttggtgatacaaaaataaacaacatttacaatgtcttctaacccacttatatccaggttaaatttcagtgtgttttgcagactgtctggtggggaaaacagtatttagtttttcaaactgtgctctgttcagaatgttgcaggattcacacagctctgtttgtactaaaatgaagagggaagggagaaaagagataaaaccttttggcatagaggtggagttacccaggatgacaaccatggagttgttgttagataaagacaagagtattttgataattagcaacataatatgaatgtaagaaagatttccacaactgaagaaaatggcaatgatttatagtgtttagccaatttaaagacagaggaatacttgtgtagttttctacctggagctgtgtaagataagataatggcatgactgagatcaaagcctaggaaaaaattttcaaaattatttgaggctttttaaaaatcaatgacagagaagtggacatgtgtaaatgaaatgaatcagtctttgtgtttttctatggcatttaggagaaagcaaattgctgtgaattactcagaagagtgaaaagttttatatttttctaatggaatcttttaaagagaaaaacagattgggtaggagacttcctgagaattctcacagtgtttagaattgctaacatctagactaagctgaaccacactgattgattttattggggaaggcctttgttttttaatgattggtcaattcaattttttactgtagtaagcacatttaacatgagctctcaccatttaacacgtttaactgtgtaatacattactattaactataggcatgatattgtacagatctctagaatgtattcatcttgcatgactgaaactttatgaggagtttctcttcaccaagataacattttgggggaatatgagaaatgatgaatgcacaagtgtcagtgcagacttcttaggtgtgaatcttagctttgccactaacatgttgtgggacattacccagtggttctgggactctgtttccttattagaaaaattaggtaaaatgagatgcccttttctcgatgctatgaaaacttaattagttaatacatctaaaataacatggtgtctatgcagtaatactgatattattattattttctaagcacatacatgccaaagaactcacacatttgatcttcgaaatataaaattcatatacacgagacagaggtgctgaaaaaaggtagaattttcaataaaaattatagagaaaaattagtattctatcaaaatcagttccttttgggggtaaagagttaattacaaagggacagcatgagaaaattttggaggatggtggttaattgccttactgtgagggtggttacacaactttatgcatttaccaaagctataaaattgtacacaagagagttaattttactgtgggaataaaaataccctgaaaccgtggcaaactatgcccattaagaaaatgagaaagggatgaagagtaatctgcaggagcaagattattccttaaataactttaaagggaggatggattggcatgattaagagctatggctggagcagagacaggagtgttggggacgtgtcaatagcattttccaaaaatttgactttttcatttgtcacttagttttcactcccatgactaagttgtgaagagtgtaagtaactctaaagtcaaaggtatcagcagattttgaataacgcctagcaatacaggtggtatcattttgagatcttctgcttcccaatagtgatctgaaaagcagcctgaacaattcaacagcttaaaaatgtcctcatgcttacaagtgaatccagagtagtggaatcaacctacagcaacaaaactaatctagcacctgtaagatgtttattaacatgaaacagaaaatgaatctagtagttacaagatacctattgttatgataaacaaaatttatatgggtattttacttaactgtttctgtagaatttattgtttatgctagctaccatagagtatgaagtgtttgtgggcacaataaagatattttttgcttgaaagaggcaaaatgtttgaaatggtattcatttcttatataagaaaactgtaattttattctacttatgttacctgcaagagttcccattttatgtacggctggctatttcaaaagggaagtacaaagttctccagatgttctacgtgaccaaataaaacctagtactagtaatgaatgttcaaaaaacagagtaggtctctgagtgatgtttaacttctaaatagtatgtgggtgacactcagttgataggtattcactagtttgtatgacttcacataaatcatattagtcctaatactctcatggctattatttccgtggtgggcccaataaccagaagcccagaaccctagggtttccataggctttctgaagtcttctgtgaggtaggtaaatagggactattttttttctaagagatcaagtcctgctatgtttcccaagctggagttcagtggctatccacagatacaatcaaagcatgtatcagcctccatctcctgggctcaagtaatcctctcgcctcaatatagttggaactataggcatgctactatcatgactggctcaataactttttttaagtgaccagaaatatcccctacatatattcctgagaaattactgctgctcaaggaaatttaggcattgaacatccgttttgggttaactgaatgttgaaaataagatgagtggcagaagatgtaggaaaagagcaaaaatctgaagttagagaactaaagaaaaaagaaggaaaaaaatgcatgatcaacaatcacttatatcaatatagacctaaaaggaatatgatcaaaggtagagatggccaaaaagaccaatttttaatgagcagttttcttaatccattcaagactgctataacaaaaataccataaactggatagcttacagaaaacagaaatttatttctcacagttctggaagctgcagggtacaagaacaagttgatgacagatcctgtgtctgtggagagcctgcttcttggttcttagatgttgccttctggctgtgtcctcacattgtggaagggccagctagctctctagggtctactttataaaagtgctaatcccattcgcaagggctttactctcatgacctaatcatcttccaaagtcccacctcttaatactatactatcgtattgttgattagggttcaacacatgaatttcagggagacacaaatatttagacaatagcagcaattattccttgaagaaaacaagtttattcagctcgtccatctctgtgctgacaattgtgggaagaaataataatgtcaatactaataagagctaacattgataaagtacttgctgtgtgccaggcataattgatacaaagatcagaagtatgaggcttacatatgtttagaaaatccatcaataaggtattacactctaaacattaagatttcctgatgaaagcctaagtgcttgctttctagtatcatacaacattcatttcatgtttttaaagaatgatcattgcttaaaacttgattagtagtcaacaatagtattggtggagtggattgtcaaaattgtattatacatacatgtccatatacatttacataaacgtatatattattatatatgcagtatgcttattatttttaaaataattacctggttggcatttgcaaacatatccattgatgtgatcttcacagtctgcaccatgtagacatggtgatgaagagcattcatttatattaatttcacaaaattgaccagaaaatccaggaagacatctaaggaaaaaaaatgaaaacgatatttgtatatattatacacatgagcactatcacttttcatcttgggattccatcattcaaacgtgttttcagagctccaacaacatgtagctgggagccttccttggggtgacaatgagttgaattgtggccccaaaacagtatgtctaatacttaacactaaatatctgtgaatgtgaatttatttggaaatagagtctctgcagatttaattaagtatcttgagatgaggtcattctggattaactcggtgggctctaaatccagtgacaagtgttcttacaagcacagaagacagagacccacaggggagaaggccacgtgaacatgcacataaagattaacattatgcagccctaagtcaaggaacacccagagcctctagaagctggaagaggaaagataagattttttcctagagttttcagagggaacatggccttgctgacactttagttggacttctggtctccacaactatgaacaaataaatttctgttatcttaagctaacgagtttgtggtaatttattatgtcattcctaggaaactaatacagagattatgttattgcatgtatctgcttaaatccaagtgaactgtttgaaaagaaataaaacagaggtctctgggagactcttaaaatggagaaattgggggcatgtcatgaaaggtatgctccataattggaagaatagatatggaaagagtcaataggtcagagactattgtacttcctcttaatttttagggacgctttaataaaaaccatttagatgtcagctgttaaaccatgcttcaagaactgatggaggatccacaatattgattaaagtgcaatgtccatagctatagatacagatttgtcgagtgcctacaacatgcaggtattttatgaatgctaagaatacaaacgtaagtaaaactctgtgtctgccttcaagaagcactgagcccagttgggaaaatagacaagtagccgacacaattatatgataaatgctataatcagcatatagataaatgtatttttatcatggcagagtatacgcaagggcaagaataagaaaagagtgtgagttaatccagaaattgcaagtagttttgaaggctgaaatataatgtgggagagcacagtctggggtgatgctgatgaaaaaggataaattaaataaatagaaattagatcattatacagtattggatcataagttttaccacatatttactgaaaacttattcacaatatataactttaccaaagtcacaagacaagcaaatttgcaaaagtagaatttattggtctgtacttatcagctagccaaatttagccactgtgctttacttgcatacacagttacttaggtgatacaaaaattaagttctgtttttcactgcaactgggtctgcccggctgaagctaggtaacgatgaattttagaccgtccagaatgttagtaactccactgtgctagatccttacctagctgaagactttcttgaccaacaaacaataagacttgctttagggccgggggcggtggctcacgcctgtaatcccagcattttgggagaccgaggcgggtggatcatgaggtcaggagatcgagaccatcctggcgaacacggtgaaacccaatctctactaaaaaatacaaaaaattagccgggcgtggtggcgggcttctgtagtcccagctactcaggaggctgaggcaggagaatggcgtgaaccagggaggcggagcttgcagtgagcccagatcacgccactgcactccagcccgggcgacagtgcgagactccgtctcaaaaacaaaaacaaacaaacaaacaaacaaacaaagacttgttttaactgtgtgtggatttatggatggtctgattttgtactgtgaagatgacatcttcagtattgaattcccactgccacagtcaacctccccatctttgtagcaaaaagaaacccatagcagtgttttttttttttttgagaggaattcatcactagtggtttactcttatatgcaaaataaacttctatgcaaaataaactcaggtctgattttgtcaataatcgaagtgttcattgtctttccttgaatatcataaattgttcttcaaaaatgcattatcaatatatttattttatttatttttgagacaggttctttctctgctacccaggctggagtgcaatgcagtggcccgattatagctcactgtaatataaaactcaaagtaatcctcacacctcagcctcccacataggactacaggtggtgtgcaccatcacacctgcctaatttttgtgtgttcattatataaaatggacattttctctgtgtccattacacaaaatgggtcatgctatgttgcccagtcacattatcaatttatattcttggcagagttatctaaaatgtccatttgtctgcgttcttacctatgaacaatattaacatttattttaattttcattgcaaaggaaaaaaactacttacctaataaagattttttaaaggggatagtttaaaaaatttttaatataatttgtattttgcgataattttaaggataacaaaaaagttgcaagggtagcacagaatgttctcatagactatgtatccagtttcctttattgttaacatcgtacattcacatggtatgtttgtcacaactagtgacacaatattactacattattattaactgaagtctatgtattattgcagtttctttagcttttatctaatgtcttttgtttctgttcaagaatcctattcagaataccacattccatttagttgcatatctccttaggctcctttagactgtaatattttctcatacttccttgtttttgatgacttcgactgttttgaagggcattggtcaagtattttgtaaactatacctcaatttaggtttaatattattcccatggttacactggtgttatatgtttctgagagaaagacatcatagaaaaggctctcatcacattatattaacattactctttagagggaagttgctttgcacatcccacgcttaagagatgagaagtcatgcacacctctttaaaggagaagtgcctatataaataatttgaaataatttctttatatatatttttaaaatcttttctggaattttgagtgaaatggctttgaatctataaaagtcaagttgtaagaaacaatatcttaacaatactgagtttttcaatttatgttaagaaatatgtctccagtgacacatatctttgatttctttcaccgatattttatagttttctacacagagatattataaatattttattagatttatacctaaatgcttcatttttgtttactgttctaagtggtatatttgttttgttttgtgtttcttctttccgatattccagtgttcattactagaaagcaattgacttcagtatgatgatcttatatcctgcaaaccttgttacactagcttattaggtccaagagcttttttcaaaaatagtagagggttttctatagagaaaattatcttctacaaagataatgattgcatctgtagataaagaccgttctgtttcttcctgttcaatctacataccttttatttcttttccctgtcttattgcactcagtaggacttctagtaggatattaaatagcagtgttgtgagaggaaatgtttgcctgtatcaaatctgaaggagaaagggtttagttttcatcattaagaatgatgttagctataagtttttaaaatgtagcctttattaggttaaggagtttaccttttattctgagattttttttgttttttgtttttatttttgtttttgagatggagtctctctctgttgccaggctggagtgcagtggcacgatctcggctcactgcaaactccgccacccaggttcaagtgattcccctccctcagcttcccgagtagctgggactagaggcacacaccaccacgcccagctattttattttgtatttttaatagagacgggatttcaccatgttggccaggatggtctcgatctcctgacctcgtgatccacctgcctcggactcccaaagtgctgggattacaggcataagccaccacacctggcctattcttagtgtttttgacagtttttatgagtggaaattaagttttgtcaagtgatttttgtgcatccattaagatcattatatggttttacttattcatctgttgatatataatcatattgattaaatgatacatgatatgataatgattgatacagtcatgtgtatttttcttgatcaagtgttaaaatagtgaactatactgaatgttttatgaatgctaaggtttgctttcctggaatgaactccacttgctaatttcagagtgtgttaatgcagtcatcttcttgttatttgcaaagggcccatgatttcaattttaaacttttaatgttaaacttttactctttgttccttcaaggttatgtgatgtttacattcttagcttgaatggaggaaagattttgaaaacacttataaaatagaagtgcataacaatttataaccccatgtttcacaaaaatatttacacaatgatctgtaaaaatttataacatggggaaattgtgctacttatattggtattataagcagttttatcccatacgtatttattcactttataagcattttaatagaatgtctgacggattgaaattacttacccaacttgtttatacaaaaggatttactaaaaactgttaaacactactacataatgacactgtcacaccaggcttttaacataagaattgctctgcaatactaggagaaggggcataaaagacaagttgattttgcagcatagcaactaaaaatataacaatgaaagcaactgttaaaaatgagaactcagaacttaacattagagggacccaacatcatgcctccatttagctaattgatacaaaagagttagtttaactgctattaacaggtgacaggagccactctcaaatgattcttcaaattggaaagtactgtcttacaacctgttgttgcagataagaagtaaatgaaatcattttgtatggtttgcagctgtttggataaccacctggcctagatactttcccataatcattctgctagttaccacttattacccaagaccttcctgaaaatcctcctttaggccctcactattgttgctgatactgttcctttgatacagctgcttttatttcacatttattaagcccatcatagtagtatttattttccattattttcttcacttgtttctgttcgttaacgataatgcagagcccatgtctccttgttggtcttttccatgggagttttatagattttaccactccaaaaacagcacttggttcatttattaagataaattatgaggcacataacaaagcaattctccagaattgctttatttgtttattaacaaatgtgtctggtatcatacaaccgaagtaagaaagaataagaagggtacaaaaactgaattttcatcccccacaatctattctattcagaaacctttttttattttttgagatggataatattttaatttaaatgagacttaattcaagttacatacattcactaaattcttatttgcctttgaaatatttacattaaaaaacaattaaatttatattctatttatattacatttataatttctaatatcccatttgctgggctttgataatataattgataggatgtagtttaataattgtcaaggaaggaacgatgttatgactttttatatctgcaaagcatcaactttaaaatattaactctaaatgctcagaagctgagtgtttatttataaacttcactgaagccaagatttctcaagttagaatagttgaaaagtatcagatatgtaaatgacttcatacaatttcagaatcaccacagttcttttccgtgatttatcttcttttttaataattagtgaccacaactacatataacttattttcttaagatatgcaaaaaattaaagtatatatctctgtgaatagtactctattagtaactgatcatacttaatcatgaataggaagcctccagttagaaatctacacacctcggatattacttctgcttaattttatttacctgtgctgtagccaaaaattttgacggtttggaatttttgccttgtttttacataagaaactatagttctgaggaataaccataaaccaaaccaaaccaaaccattttacacttcacttacccctgtgtcctgacctcttctctgtcctggatgatataccagaatatctaactggattcatccttcagatgaatggccatgggcttacaaatttgacatattttcttttttaaaatgttatttttatagatgatattgtaaacttctatgtttctgggaaacacaataggagcatcaggttgataagtaggggatattcagtgaataggcaaagccaatgatctgagcagaatggtcttgattatgagttcaatattatactgcttctcatttcagtatttttattactattcaattgatcacattatatgctctaaatttttaaaaatacaggtattttaaactcatttcattgctttgttgcagagactgtgatagattggaatctaattattaaatgtattttcaaatgtgtaatttaattttattatagtcaaactgcataaagcataatccaaactgaattataaaataagtaattttagtgttgtttatattatgtatcttgaaggtcattttaatttaacatttttacttttatcctgagtaattctattgtcactatcaattatgcatacagattaagaggagttattcttagcaattattgtaacataaaccaaagtttcctgaaaccactttaaaaactagaatattgtctaaataactgttgaaattgtatgtagacatatacaaagatttaggtaaaaaggacattaactacacctgtctccgtagttatgaatgaatgaaactcaaagtagttcctttttatagatgatattatttcgtatcactttttagtaaaacattgctttatatattgatattgacagtatttaaacttcattaatttgaaatgatccatatgcagaaattaagacagagctgggtgcaggttgtttatttagaaggtgatccaagtaagcagaaatgaaggagtggaaagaacaaaacagggaaaaataaaagttaaataagaatgcattatttagcagtttgtcacattgagcaactgggactcagtctgactgcagtagttttcacattctttcatacttttctcagcaaaaaaaaaaaaaaaaaatggagcctaagcccccttttaacccccatcattggaaagttggcttcctcctactctgtttggatctcttgtgcaggcaagctagacagtctatcataaagaaactcatgtatcactataaagaggcccatgtggaaaagaactggagccttgaccaatagccacataagtaaatatagaaggggatctttcaaccccatgtgggtctttatatgattgtaatccagctcgcatcttgagtgcaacctcctgaaatatactaagccagcaccacccagacaagctgctcttaaattcttgactcacagaaatggtgagatgacaaatgcttgtgtttgtttctttgtttgtttgtttgagatagagtcgtgctctgacatccaggctggagagcagtggtgtgatctcaactcacttcaacctccgcctcccgagttcaagcaattctcctgcctcagcctcccaagtagctgggactacaggtgtgcgccaccaagcccagctaatttttgtatttttagtaaacacagggtttacccatgttggccagcatgatctcgatctcttcacctcgtgatccgcctgccttggcctcccaaagtgttgggattacaggcgtgagccaccacacctggcctaaatgcttgttgtttaaacaacagaattttgagggtagattgttatatgcaatacataattatgtacaaaatgaggactaattgaaaaatctgtaaagaagacaaatcagaaactacctcagaaccactgatgaacaaagcaattattcactgattcttattccctactagccatggatagctcataggctaatacgggcaaacttctgggctgatttatgagtggctatcttgtgcgtatactcagtaagataccctagcttccaaaaaaaaaaaaaaagagccctaaggcacaaaagtacaaaatattgaagtgtggtatagtcaatatacttgggaactgtccagcacagctgggatgagatgaaaagcattaaaaacaactgctccacatgccatgtgaggatccccaacctatttcatatgtcaaaaaacatctaagaaaaaatgaagaagggaatttaataaattcaaactacactgagaactttggttaagataatttttctcttctatattccacttttaagaacattcaatataaaagaaattagatttttattaaggggactatttttaagagataacaagcatgatggggatggcattgaatctgtaaattaccttgggcagtatggccattttcacgatattggttcttcctacccatgagcatggaatgttcttccatttgtttgtatcctcttttatttcattgagcagtggtttgtagttctccttgaagaggtccttcacatcccttgtaagttggattcctaggtattttattctctttgtagcaattgtgaatgggagttcactcatgatttggctctctgtttgtctgttactggtgtataagaatgctggtgatttttgcacatggatgttgtatcctgagactttgctgaagttgcctatcagcttgaggagattttgggctgagacgatggggttttccagatacacaatcatgtcatctgcaacagggacaatttgacttcctcttttcctaattgaataccctttatttccttctcccgcctgattgccctggccagaacttccaacactatgttgaataggagtggtgagagagggcatccctgtcttgtgccggttttcaaagggaatgcttccagtttttgcccattcagtatgatactggctgtgggtttgtcatagatagctcttattattttgagatatgtcccatcaatacctaatttattgagagtttttagcatgaagtagttgttgaattttgtcaaaggccttctctgcatctattgagattatcatgtggtatttgtctttggttctgtttatatgctggattacatttattgatttgcgtatattgaaccagccttgcatcccagggatgaagcccacttgatcatggtggataagtgttttgatgtgctgctggattcggtttgccagtattttattgaggattttgcatcaatgttcatcaaggatattggtcaaaaattctcttttttggttgtgtctctgccaggctttggtatcaggatgatgctggcttcataaaatgagttagggaggattcccgctttttctatttattggaatagtttcagaaggaatggtaccagctcctccttgtacctctggtagaatctggatgtgaatccatctggtcctggactttttttggttggtaagctattgattattgccacaattttggagcctgttattggtctattcagagattcaacttcaatcccatccccatcaagctatcaatgactttattcacagaattggaagaaattactttaaagttcatatggaaccaaaaaagagcctgcatcaccaagtcaatcctaagccaaaagaacaaagccagaagcatcacgctacctgacttcaaactatactacaaggctacagtaaccaaaacagcatggtactagtaccaaaacagagatatagataaatggaacagaacagagccctcagaaataatgccacatatctacaaccatctgatctttgacaaatctgacaaaaacaagaaatgaggaaagcgttccctatttaacaaatggtgctgggaaaactggctagccatatgtagaaagctgaaactggatcccgtccttacatcttatacaaaaattaattcaagatggattaaagacttacatgttagacctgaaaccataaaaaccctagaagaaaacctaggcaataccattcagaacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaattttgcaacctactcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaatgacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacacgtatgtttattgcggcactattcacaatagcaaagacttggaaccaacccaaatgtccaacaatgatagactggattgagaaaatgtggcatatatacaccatggaatactatgcagccataaaaaatgaagagttcatgtcctttgtagggacatggatgaaactggaaaccataattctcagcaaactatcgcaaggacaaaaaaacaaacaccacatgttctcactcatagatgggaatcgaacaatgagaacacatggacacaggaaggggaacatcacactctggggactgttgtggggtgtggggaggggggagggacagcattaggagatatacctaatgttaaatgacgagttaatgggtgcagcacaccaacatggcacatgtatacatatgtaactaacctgcacattgtgcacatgaaccctaaaacttaaagtataataataacaaaattaaaaaaaagagataacaagcaaatggccagaaccaacctggacaatgaaacttacctcaatctatcaccacgtctacattactctacagtgatcagaaatctcttctcaaggcaaaattctcaattattattgtcagtgtggggagggagctgggagagggagagcatcaggaagaatagctggtggatgctggtcttaatacctaggtcatgggttgatctgtgtagcaaaccaccatgacacacgtttacctttgtaacaaacctgcatgtgtaccacacataaaataaaagtttatggtaaaaaagaaaaaagaaatttttttgttctttttttacagtagcatgctatttctagatcaccttttaaaaaaaagagaatgaatacaactccaccaggcaccctgatggaccaaacccaacacaattcaaatatactgaacttaaggatacactgagcatttcagagcaacccactgtcctgaactgacagttcaaaaatgtataggagtgcattctgagaatacaactatatgatattttaaaaattctttattttatgaaaaaacaattttaaacacaggcagactactttgaactttggatataaatgttgggaagaatgtaggaccttctgaggcagggacagaactaaactttaaacagaactagcttattcctgaaagtgtttagttataggtagatacattgttcctttctaaagaagctatgactagactctctattaaatctaaaatagtgagaatatgaattgtatttacaatagaatacagaaattaataaattaaatgattattaaaatacacgcataatgttgtaatgataattattaagagctgtgaattgtcattcatctagttacctccacaacataaagctcctgtcttagttcagtccatctttcattttcttttaatttttaacatgtgtctttttcattatttgggagagttctagaatgagcaagacatcttgcctgtgttctttttagactatcttcaccctgagacaacaaaatcctccctgacacatctatctcatatatactttgtagtggggggtttaaagccatggcctcaaaatattcaagtgcagtcattttcaagcaattttctctgactatcttttcctctgggttttttgagggtgttaagaacatggtgctgatgtttctacttccctaccaaatgctgttctaatgttaccagttaccaacatattcaagccactcattttgtctttaaccacttgatgtgtttaacagttccttggttgctttagtaaattctttccttgtttacctccctgccccctctagtagattttcagggttgccataagaaagcaccacagataagtggcttgaacaacagaaattcattttctcacagttctggaggccagatgtccaaaatccatgtgtgggcaggatgacaggattggtatcctctgaagccgtctccttgacttgtgagagactgtctcctccttgtgtctttgcatggtcttccctccatgcatgtttgtgtccccatttcctcttttttataaggacaccagccatgttagattgaggcccaccttcatgacctcattttacctaacttaccttaattacctctttaagagacctgtctccagtcacaaccttaaagcaggtcttggaaaattacaaaatcaattttcagaaacttcatgaacatttatgttttcaagcatgagtattatatgtaaatatacatctcttttttcatcaatttgtggcttttaaaatcatgctcagttataagcattatacaaatttttcccatttcttaatatacaaaccttgaaacattctataaattaaaaagcgttttgcagcttttagtgaaaaggcattgcatgggaggcccttatgctaaagattaaaattccttacaccttatacaaaaattaattcaaggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctcattaaactaaagagcttctgcacaggaaaggaaactaccatcagagtgaacaggcaacctacagaatgggagaaaattttcgcaacctgttcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaaagacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatatacagccataaaaatgatgagttcatgtcctttgtagagacatggatgaaattggaaatatcattctcagtaaactatcgcaaggacaagaaaccaaacaccacatgttctcactcatagatgggaatcgaacaatgagaacacatggacacaggaagggggtcatcacactctggggactgttgtggggtggggggagtggggagggatagcattaggatatatacctgatgctaaatgacgagttaatgggtgcagcacacaagcatggcacatgtatacatatgtaactaacctgcacattgtgcacatgtaccctaaaacttaaagtataataataaaaaaataaaaagattaaaattcatgcaaagtattaaataaaaacattcttaagcttcatgatgaaaacaaaacaaaaatagctttgtattcttttctcgttctttgtaaccactaaacacatttagtgtctcattttggataaatgccattggaacacgaagctcagaatctaaggtcagctgccctattcaagaggcttaggacttctggatcctctcattcattaacgacatgacatttctactttatacaaaatattcagttgaaattaaattctccctaaccaggtagggcaggcagaatttgtttttaactccaaagctatatcttcacaatagaactacttggtattagtccattttcattctgttgataatgacatacccaagactgggcaatttacaaaagaaacaggtttaattggacttacagttccatgtggctagggtagcctcacaatcatagcagaaggcaaggaggagcaagtcccttcttgcacagatggcagcaggcaaagagagagtttgtacagggaaactccccttttgaaaatcatcaaatcttgagagactcattcactatcaccagaatagtgcaggaaagaacctccaccataattcaattgcctcccaccaggtgcctcctacaacatgtgggaaatcaagatgagatttgggtgtggacacagccaaaccatatcatgcttataatagtttgccaactttacatggtacagattgcatggtacagtaagaagaccaaatcaatgaatgggttccatgcatcaaaatagcatcagaagggaatctcttgctctctttctctctctctttcacagagacattgtggttgggggtgaatttcactttgagataaaaactgatttcactaacagtttccctttcatacttaaaaaactttactgtgtaaggcagaggtctccaacacccaggctggggactggtacaggtccatggcctgttaggaactgggctgcacagcaggaggtgagcggtgggtaagggagcgttacctcctgagctctgtctcctgtcgcaccagcagccacactgaattctcataggagcgtgaaccctattgtgaacctcatatgcaggggaattatgttgtgtactccttatgtgaatctaatgcctgatgatctgaggtagaacagttttatccccacacaactactccttcctcccatatgtgaaaaaattttcttccaaaaaaccagtccctggtgccaaaaaggttggggactgctggtgtaaggatgagatagctgttactaccactgtgtccacaaaaagaacaatgtagttagactggaaataacatgaagacagaaagattctggctccttgatggcatcatcaagctgctgaaagaaatctggaatcaccaactcttaagtttctgattttggggaaaaaaattaatctgtattgtttgtccattagtcagtttgttgttctggtggttacttaaagttaaaagcatcttgaattataacatttttgttttaaatttcattcgtaatttatctttatatttaacattcatcttaataaacttttttaataattaccagttttcagaacacatagaaatatgatatttgaaaaattatggtagctgagatttaatgtgccattatatattatgctctgtatttctccatggttatatacacatattttcctatacttacaatcgatatattcttttcttcccctagcttataaggttatcctactgtgagtgaagatgagagatatgacatagccctttctgtgctgtgctcttgtctccatatcattttgtccacattatttatttcaacatatataattttcctcttctttggagaaatcataaatgaaatgcttcctgtgaggaaaacttacattcaatttttgagtagccagggttcctgccagagagataacacttgtccagctaatgcattactaaaaagcaaacaaacaacaacaacaaaacctatgtatctattcttttcattctctctaaaacccttctctacattgagaggatagaagaaatgtgctgtgcaccccttcctttattaatagatagtactgggccaggtgcggtggctcacgcctgtaatcccagcactttgggaggctgaggcggacagatgacctgaggtcaggagttcgagaccagcatgaccaacatggagaaaccccgtctctactagaagtacaaaattagctgggcgtggtggcacatgcctctaatcccagctacttgaggggctgaggcaggagaatcacttgaacctgggaggcagagattgtggtgagccgagatcatgccattgcactccagcctgggcaacaagagtgaaactccatccccccccccaaaaaaaaacaacactgaagaaaagacgacttttcaactcctcttagttggtccaaatgcacccacttcctttcttagggagagaagacatgtgcttttatccatagagtgtataattggcatctaaatttagatatcaggtcagtgcaaaagtaattgtggttttgtcatcactttaatggcaaaactgcaattaattttacaccaacccaatactttggaggtttaaagtaagtcttactgttaattgtcctgggccaaaaacatgaataaacaaaaagaatttcagacaaagtggtatgtatggtcatcctacccataaaaggtctatgctctttggatgcttggcatcttttcctctaaggaaatcccacgtggtcctgggcagagttgggggtgagagtaggtgtagggaagtgtgtggtgttaacaatgatttcccaccacatatcccctgatacggtttggctgtgtccccacccaaatctcatcttgaattgtaacttccacaattcacacatgtcatgggagggacccaggggctggttactgaattatgggtgtgggtctttctcctgctttctcatgatagtgaataagtctcattagatatgatagttttataagggagagtttccttgcacaagctctttctttgcctgctgccatccacgtaagacgtgacttgctcctccttgccttccaggatgattgtgtggcctctccagccatgtggaactataagtccattaaacctctttcttttgtaaattgctcagtcttgggtaggtctttatcagcagcgtgagagtggactaacacattctgtaaggcactgaagtgatccaagctgtttaatccaaaaagctagttaatatatttcctgtaattttgtttgctttggaagtgagaattttactcaagtggtatcaattaagttttcttatatgacctgatttttcttttgaattgtagcctaagatacagtgaaggttaccagctgcaattttccccaccatatgtatacagtctacctttcagtaaagtcattatatacaagggagcagagtcaaaagataaataatttctggacgagtcattcctggatccagctgtgcttgaaattagcatcataatggagcatcccagttttatgagccataaaaattctatatatgacttaattaggcagagttaatttttttacttgcagttgacagtattaaaatggcatttttgtcatcttaggatttaaaagaattgggatggagtgaagagggtaagaaccaagagtaagaggaattaagataggagattatttctattgtgaggctgatcatgatgagaatgtatgaattttttatattttaatgtgcaatatgcttttaggaatgcatattctctggagatataaactatattcataagaattattacaaagctaatacattctggagatttatacttatatttaaccattttaaatacactaatatccagagaagtagtagaacattatgatatgaaaagatgatgagcaaggaaattatatatgcatggaaaaatatgtttgcaaaccaattcctgatttcagcctacctgaattgatataaatgtatattttaatgcagttaaaataatggtctgggttctcttacactgcaattgctaactatagctcatgtcatattctcagggttagtgcaatcatttacctgtgccaggcagctctgaataaaaaagatgtacatttactggatgggagaaatttctatatgagcctacaggatgcagcatcagcatgtcagcttcctgaactcttttattagtagttattttctgtgtaaaattttattgttttttaaatctctaatcacatttagtgagtaaacaactagaaataatcacttaccaattcattcatcagaatattattttacatcaactagcctttaagaagtagctaaatttctttggaaaactaaatactgtttaccatttctctttgccaccagactaatagaaagttttaggtatatctcactgctaaaacccaggctgaacactaagcaattgggagattgaaatgaacacatcattatccgagcaatgaaacattgaaaatcagacactggagcagtctcgtgtttgaatcaacaaataaaacagaagcattaagatttcaataaggtgcttaaacaacttaaagcagaacgattttagacaaatcacaatattgaatcctctctgggaacatcagtcctgtatgtaatcatggatctgaaattgacttcatgggaaattcaccagaagaccattttctaatttaacagaaaccaagaaacagcagtatgaaatagtaaaggtgtggaatattaagagtcagagttttaaagttcttgacatcagacggcgtggagatgagtaagatcactgagaattagatatgtgaccttggtaaatgacagatgcttttcatctataaatatccacaagctttttcatctgtaatatttggattacattagaaccaaaatcgtaggtctttttaaagatgaatgtaaataataagtgtaataataaatgaaaaaataaacttattagaatgctgtcagaaataaggctgcttaaatgctagtgattttttaattctctttttttagttctcttttattgctatgattgttgttactgaaaaattaaatttacattattaatagtgcaacaggcatattgttgagatgactaaggttaatctgtctccatttgcttaaatactctaaaagaaatacagcttgctattcttatcacaaaagtatatttttaaatcttttaatgtttctgctaaaatagaaaatgtgttaagatattagacagttacagttaacaagtttgaaatattaatattgaaaaactatactaggaagtaaaaatcatttggggatcctaaattctcagggtagctacacttcttgtgtaacagctatagaatctcagaaaaaagagaatcaagagaaaccggcaggggctacaaggcattttccaacccagtcgtggaagcatcacgtctgccctgttacttcagttgaggcatagagacatatatcgtatttataaccctaaaatctattttgagttgtggatgggctgtcaataaagaataacaaatatacataatcaactttggtaaaatgcttgagaaagggaaaaaatcaaaagtgaatcattcattggattcattatgaagatttcattgctctagacatatgattctgactcatataatggtaaaagagacatttaaccttcttttcccaaatattctcatattataagtacatgattgtctgctttcagatatttatgaagtttgagatatttataagaaaattctttataggcagggcgcggtgactcactcctgtaatcccagcactttgggaggctgaggcgggcagatcaagaggtcaggagatcaagaccatcctggctaacacggtgaaaccccgtctctactaaaaatacaaaaaaacattagccgggcgtggtggcgggcgcctgagtcccagctactcaggaggctgaggcaggagaatggcgtgaacccgggaggtggagcttgcagtaagctgagattgcgccactgcactccagctctggcgacagagcgagactccagctaaaagaaaaaaaaaaaaaaagaaaattcttcataaatgttgagttgcattattcctcatgagcataataatactattaacatgggatgaggtcttggagtgttacctagtttatacttctttgtgacagttatgacaaacatttgtaaggcattttaataaaggtgaagaaagagtagtgaatggaatgtcaaagatgatgccaataaagaggtaaagttgatttttttctaattttccaacttataaaagaaaccacttactgtgtaactgtgagacatattctacttcaagaagtaatatttacataatttaatactgaagtaactgtatgtccgaaaacatctcatataaaaatgtaaattacatcacttgaaaattcttcatatcatgcctatttttatgtaccaaattttagtaaagtacctcctgacaaaagaatttctaaacaaaaatgactacaaacaacagtaatactgagaaaggtcaaaattaatgcaaaaaaagaacatattctcacatgaaaggcagtttttaacacacacacacatattgagagagacagagctagctatactgaatttctagaagttatttaaactctacaagataaaattatcttaatacaggtaactttgttttggaattgttcattatgttcatgaagaatactcaacaactttataaactattaaataaacaaatagctatgtacagattttctatatgtataaatcactacaaaggaaagatgctttatggcactataccaatgattatcactttgtggcaagattatggctaatattttttatttgtgcaatcctttaaaaatattctgataatgaacatacattgtttctatagtcagaaaattacatgataaattatattaaaactcagttaaataaagaaaaaaaacgctagtattcttcaaactttttttctttaccagaggttttacttcaaacggcatttgttattctttattggcaaaattgttcaaccgactccttataggtaggaacctttttgcttatttaacctccagttggtgatcataagggtttatagaatgcatgagtgccttcatgaataaataaatggttttaaggaaaaaacatgcttccgtaagaaaaaatatctaatttcctgacatttgcctactaataattgatgtggtcatgccaatcgccctgtgaattacagggtaattataaccattgtatagccagttatgcttaaatggctgattaattaatcatgtattttgcatacaaatcttgtgttctctggatccagctaggtggtgtgttctctcatacactcatagccttatgatggctggcactgatgttatctcacctacctggtatttggactgaaaagactaaaaactaggggcagaaacagctgagctccttgccctccccctggtcttactagtttctctttgtcatggcctcgaggtaaccacactgcttgtgtgacaaccatagactcccagaaaaagaacatcaagaaaaactggcagaagctataagctgttttcctacctagccatgaaagcatcatttctactctattatttctgtctctattggttgaaatgatcataaaattctgtctgtgtttaagagagtgtcatagacataacttcttggtaagagaaatatcatataatttggaaatatggtctgaaaccactacaatctataggttaaagtacaacggcttaagggcacttaaaaaactgattgataataaattaacacagtacttctaagagtgcataatctgagtcaaatcatgtggaaatgtcagataaaccaaaattgaggcaaaattacaaggtaaacgatttataatcatcaaaaagtaaaggtcataaaagaaagatagactgataaaccgttcagaaggtacaactactaactataatttaggaatggattctggagggggaaaagtagaaatggagaaatagctaaaaataattttattgagataatttatgaaatttcagtaaagcttgtggattagcaaattgttttacatggagtttaatatcttaattgtgataatttaccaaggttatataattgaatattcataggaaatgctgaagtatttaggggtaaggctctgaatgtctgcacattttctctcatggttcaggaaaaacttgtaggcacttgtgtgtgtatgtgtatactttgcactaccttatatatacagaaagaaaggaaaatagaagaaatgatttagaagatctaacagttaagaattgatgagtccagatgaagagtatacaagcatttttttgctcttactgtaattttcctgttatgtttgaaattataacaaaatttaatgaaaaaagacactttaccatcataaaacttttccagcaacacactcaacattccagatttgccactatttaattttgaattataagcatatttgttaaatccatacttgtaactttaataatatgcttacatataatattaggactccatatatttctataactgccttttttttttgagatgtagtcttgctctgtcacccaggctggggtgcagtgccacgatctcagctcactgcaacctccgccttccagggttcaagcgattctcctgcccctcagcctcctgagtagctgggactacaggcacctgccactacacctggctagtagtagaaactttagtagagatggggtttcacaatgttggtcaggatggtcttcaactcctaacctcatgttctgcctgcctcagcctcccaaagtgctaggattacaggtgtgagccaccacgcccagccaactgctttctttttatagaaatcataattgcttctcatttttgtttgctttgttttctattttaccatcactaatttatctgacaaatatctcaaagacatgacaaatcaatgtccaagagaaaaatttgagtatctttctttcagaaagtgatggaacagtgaacaaaaaattaggatttttaatgtttataatacattattaagaaatttgatctcataaatatatatctagaaccatggcccaaggaaatagaatatattttgtgagggtaccatggactactcacagaaattaaccagtttttaagcctcaaagaaattttaataattcccccaaaccagaaatcatcatttagaacaaattttaaaatccaaatttaatataatttgatatctaacaaaatttcacagctaacagaaatattttcattgggaattttagaaaatactgttaagaagttaatgagttaaagagaaaatataaatttaaatgataatctagatatatagccatgcaaatactacatagcaaaaactctggtttaatcaaacattctcagagaaaattcaaagtttttaatgcatctataagaaaatattaaaaattaagtaaactaaatctttaagtagctacaaaatgaataaaataagaattaaaattatattaataaaagtggtaacacattaatttaacattaatttaaaaatacttaacaaaacctagatttttagttgttgtatttatcccttgaacaatgagtagaaaacttttagccagtgtgactaaaaacaaagagaaaccccaaaaagaaataaataacattaattacatgaaagatgagctggtgaaaatgtggattaaatgaaagattcataggagaatttaactttatacagcagtatgcttataaacctatactaagtgaatgctttttcaaagaaaatataaacttacaatattgttttgaggaaagggggaaaattggaaagcacaaattgtcagagaatatagtaaaaattttgactcctacagtcaccaagcctgagctctagtatcatgtgtactataaaaattttaagaaatatgtaaattcatgttgtataaactgtctcagaacatagaaaaaaggtgcttttcacatctacctacaaacctagagtaacctgatattaaaataattcaggtaagcacatgtacccactaaataaattatacacatatctttgaaaatcatgaagaaatcacaaaaataccacagcaatatattaaaaataataaaatataaaaatgtatcttcacgtttattgtttgactaatagaagaataaatacaaccttattgtctggcaactccttaatgagttatgatttacctatattatgaaatattatattgttatcatgaaggagccaatttaactattcgtgtagacagattccccaatatggttaactaaaaaagccagtaacttaaaaattggtttcaatgtctttctaacctaaaaaaaaggtccacatgaatattatagatagataaatgcttacagaaaggatagaatggttacgtatcactctgttaattgtaattactctggaaaaaagactaaatagttgccaggagaaagatgttattttaagaaatattatagtctacagttctatattacttgaatgcctcatattgagaatgtatctgtatatatgtgcagttcaaaaattatgtttgtttttgtttttttccaaagtacctaaaaataagccattagattagagagtagattcatgggaataatcagagagggagagggaagagagaatatgaaagataataaagtaaaataaatgaggaagggaaaatacagggcaaaaaacaaacttgtaaaaatattcataaaggctaggcacagtggcttacgcctgtaatcccatcacatcgggaggctgagacgggagaatcgcttgaacccgggaggcagaggttgccattagccgagaccgcgccaccgcactccagcgtggtgacagagcgagactccgtctcaaaaaaaggaaaaaaaaattcataaaatacatatcagagaaaagttcaatattgttataagagattttatatatcactgagaatggaaaattagaacaaaatgaatatgaacataaagaaagacatattagtgaacaataaacctaactcaatgttttctcttatttatcattttgataatctacagttacataaagtaagataccaatctttatcatattgcttatcaaaagattttgctgttattgtttaatgttgagataaagttctgttaattggcatacactggcatacaggcactccaagtgtactggtggaagtgaaaattagactttaacaacaggttttaaaagcttacaaaaatttgcatttactttgagggagcaatttccctgccaagaacttattttaggacagttattctcaaaaacacaaagatgaactaatgagatgatttttagtaggcagaattctaaggtgacccacagtcatgtatataatcttctcttaagtataaatgaagcctactaatattatgaaatgtcactttgtgatcaagttttatggcaatagagaaattaactgggggtgggccttaatctaatcaggtgagctcattaaaaacagtattttctctgatggggcacagaaagggcagaaagattcattctggctggcctagaaggaagcaataatttgcattgtgaacaagggggcaaggacctaacgatgcatctaagagctgaaagtattttctacctgacaaaaaatggaaacctcagtcctacaaccacaaggaaatgaattttgccaccatccattgagcttggaaggaaaccctaaggcctagagagaaactacaaccccaacaaacactctgattttagcccagtgagactctggacagagaaccagtcacgccatgcctgaacttctagtctacaaaaactgtgagaaaataaatttgttttgtttcatacttctaaatcagtgataatttgttatgcagcaatatgaaactaataccatattcatgaaatcgtcatttatgatagcaagtaaatggaaacctcctctacatgtagcgataaagaacaggtaagcaaaatatgacatactacacacagcaattaactctcatgtttgcaaagcctatttacaaacttcgtaagaactatgtataaaattccgtgtgtgtgtacatatgtgtgtgtgtgtttgtgcattttacatacattcgcacagttttgcattgcatattattcattaggggttgaattctgtctctcagaaaaggatatttgaagtcctaattctcagtacccccgtatgtaacgttatttagaaataggatctttgccgatgaaagtaagatggggttattagagtggactctaatgcaatctgactggtatccctaattaaaatcagaaaattgggctaaatggagagaaatgcaccaagggaagactatctggacacagggagaccaccatctataagccaaggaatgcctgatgctaccaaaagctactagagaggaaaggagctttcccttacagttcccagcaaaaaatcaaccctgataacaccttgatttcagactagcaccaaactatgaaacaataaatttattttgtttaaaccacccagtttgtgatagtttgttatggcagccaggaaagtaatatagatacctctatgttcatgtagatggaattgcaacaaaatttaacagtgactgtctcagttattgggaatatattaggcgggttaatactcaatttttaatatttggccacatttaacctataaacgtggcaatttgacatgtttcagttcattaatttcttctatattttttgtgctcatcttaatttttaattgtctttcttttcatttttttgagacaggttcttgttccccaggctggaaggcagtggcgtgactgtggctcactgcagcctcaaccttttgggctcaagcaatcctcctgcttcagcctcctgagtagctgaaaccacaggctcataccaccatgcccagctattttttttttttttggtagagatgaggtcttactatgttgccaaggctgatctcaaactcctaggcttaagtgatcatcccgcctctgcctcccagaatgcttggatgacaggaatgagccaccacacctagcctcctctaaatttttgaagttttcataatatgtgttatttccatagccaaataaatttgataatcacaaaaagtagacaaccctcttcaaataagcaaatgttggagattatttatattcataaagatgttaaaccaagatgaattgctaacttgaaaatcatttcctttcctatattcctttttctgcattcagtctcttcatatttaccttaagatgttttatagtttatgcattatttgtatatgtcaggttttaaattgaaatattagaaacagacattattggaaacagcagttttctgtttctactagagcaaaataactaatgggagattaatattaatagactatgcactgaatttttcttataaaagttcaattgtctaataaattaatgatacctctcacttttacaaataatatgcatatctctacttgctagtgttgatctgatcattcaataatcatttaaggattcattgaaatccaaaaattggctaagaaacatgctactgttgtctagagggaaagacaggcatcaaacaagcaattacaaaaatgtatggttagtcttataatgggaaacatgaattatatggaactaaccaagtcaaaggtgagaaaatgccctctgaggaagtgatttgcaaggtgaagttttccgatttggcaggataagtaggaccaagttgcagagggagctggggcttgcactgtatagaatgattaaaaatagaacaaatgttgcttgacaaagttctgtgattttagttacaacacctgaaaaatgttatgatgctattgtcttttaaatacatgatttcttttgacatgaatcctgattttttagaaatattttcaaatctgcattttctgtcacgaataaatctcattaactgctccactccaaatggccacttctgtcactgcaaatttatatagggacagctatacattattaacaagctatgaaaagtcaccggctaaatgtcaccaaagctgaggtatagctgcaccttgggattcatatagcaaacagtttagttttaatcatcccggaccacaggatgtcttgacatttgagcagcaactttttcctctttaacttgcactggaatcagacctctattatctcagccataatttttagcttaaattgtgatagaaagttttaccttctaaattaaaaacgtgaaaaaaatcgatccatcaaagaacttatcattcatgtaatcattgctcacctgcagccctcttcctcttaacccccactccaagaaaggtgatcaaggacagctataaaattcaaacatctttagacctgccagaaattttttgagctaaatgcttttctgttacattaagacctacaagaaatgaccttgctgaactgcattaagagagatgattgattttaccgtgaaatattttttattttgataaaataagtaggtttcatatttttaaaatatgcttttgaatctttttctgctcaaagtctaataatgttatcaggatatcaatctttgatgcctacaaagtgtctaaatttattaatattttataaaaaatatctaatgcatattatatatttgagtcttcttaagatctatcattttagcccttcattgtggagcattcacagtaattaacatagtaattagaaaaaaagggaaacagacatatcaataaagataatgtttgctatatatatgtgtcttataacctcatgctgtataccttaaaatggtcatcaatacaatactacaaatgcattacataacctgttctgaacaaatatgactggcttactgataatttttctatatatataataagtcatggataagcaattattaaaaaagggcttattgtcaaataaattggcttattggtatctatcatacagctcttactttatttaataataaatatcatatggtccataatgaatagtatagtgaatgcatacatcaaaataaaagtagatgatggaatttaaaacaatgatcatagcattgtttcttaactgttttatgagttaacacctaaaaatatgtaaatttataatatgtcttctttttatttcaccaaaaaatacatgtgatggaaaattgtctatggttgtcttcacctctttgaaaagttaacagcatcacttttatgtttgcttctattttctctattttatgaacaacattcaagtagtatttgtcaattacctattatgttatgaggtattgtaggtttcatacagtgatgagcaccatggacaagatctttgtagatattacaatcaaatacagagagaaaaattagtatcacagaaaaaaaaataaatgctgctatgttttacgatggtgtctaatgagagatacaactttattgagtgggttggtgggaggtggggaaagaagattttcccatacctgttcttttgagagtgagttaggggagcattagcaattattcttgaataacaggcttaactcaggcacatatttagtcaactaaccctacaaccttgactgattgatggagaatatggtaggtcttgagaacttttccaagacaggaataccttagttgggagtctccagaaacagaccttgagcaaaaagtttgagtagaagtagttttttaggagatataaaacacacctaaagttgagtaagttggtagatgaaagagaatgtagaaaatgaaattaaatcaactattaaagtgggtgcttagaggttattcccctaggaaactctgatcaaccgtaaaaaacacacacttcagaattatcccacctgatagactaagaaagctaaggtgtgtatacccaaacttccatcagtaattgttgggggctgcatcctggattgggaggatgagaaggggaagggggttaattcaccagaatttctgttctgctttgcatgaaagtagtttctgaaataaacaagctcataaataaatacacagtttgctggaaattggctgtaaaaggttgaaatggtaggatgagaggagtaggagtgatagccacccattagacaacagcatgacagagtgagctaaggtatttgcatctattaagattatcagtctcccattattattgtgtgggagtctaagtctctttctaggtctctaaggacttgctttatgaatctgggtcctcctgtattgggtgcatatatatttaggatagttagctcttcttgttgaattgatccctttaccattatgtaatggccttctttgtctcttttgaactttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactttttatccaatttgccagtctgtgtcttttaattggagcatttagcccatttacatttaggcttaatattgttacgtgtgaatttgattctgtcattatgatgttagctggttattttgctcattagttgatgcagtttcttcctagcattgatggtctttacaatttggcatgtttttgcagtggctggtactggttgttcctttccaagtttagtgcttctttcaggagctcttttagggcaggcctggtggtgagaaaatatctcagaatttgcttgtctgtaaaggtttttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccccttgtaggtaacccaacctttctctctggctgcccttaacattatttccttcatttcaactttggtgaatctgacaattatgtgtcttggagttgctcttctcgaggagtatctttttggcattctctgtatttcctgaatttgaatattggcctgccttgctagattggggaagttctcctggataatatcctgcagagtgttttccaacgtggttccattctccttgtcaatttcaggtacaccaatcagatgtagatttggtcttttcacatagtcccatatttctgggaggctttgttcacttctttttactctttttcctctaaacttctcttcttgcttcatttcattcatttgatcttccatcactgataccctttcttccagttaacaaatcggctactgaggcttgtgcattcgtcacgtagttctcctgccttggttttcagctccatcaggtcctttaaggacttctctgcattgattattctagttatccgttcgtctaattttttttcaaggtttttaacttctttgccatgggttcgaacttcctcctttagctcggaagtttgatcgtctgaagccttcttctctcagctcatcaaagtcattctccgtccagcattgttctgctgctggtgaggagctgcattcctttggaggaggagaggtactctgatttttagagtttccagtttttctgctctctgttttttccccatctttgtggatttatctacttttggtctttgatgatggtgacgtacagatggggttttggtgtggatgtcctttctgtttgtcagtttttcttctaacagtcaggaccctcagctggaggtctgttggagtttgctggagatccactccagaccctgtttgcctgggtatcagcagcggaggctgcagaacagcggatattggtgagcagcaaatgttgctactggatcaatcctctggaagtcttgtctcagaggagtacccggccatgtgaggtgtcagtctgcccctactggggggtgcctcccagttaggctacttgggggtcaccccactgtcaatattagacagatcaacgagacagaaaggtaacaaggatatccaggaattgaactcagctctgcaccaagtggacctaatagacatcttcagaactctccaccccaaatcaacagaatatacattcttctcagcaccacactgcacttattctaaaattgaccacatagttggaagtagagcactcctcagcaaatgcaaaagaacagaaattataaactgtctttcagaccagagtgcaaccaaactagaactcaggattaagaaactcactcaaaaccgctcaactacatggaaactgaacaacctgctcctgaatgactactgggtacataacaaaatgaaggaagaaataaagatgttctttgaaaccaatgagaacaaagacacaacattccagaatctctgggacacattcaaagcagtgtgtagagggaaatttatagcactaaatgcccacaagagaaagcaggaaagatttaaaattgacaccctaacatcacaattaaaagaactagataagaaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagacctttagcaagactaataaagaagaaaagagagaagaatcaaatagatgcaataaaaaatgataaaggggataccaccaccgatcccacagaaatacaaactaccatcagagaatactataaacacctctaagcaaataaactagaaaatccagaataaatatataaattccttgacacatacaccctcccaagactaaaccaggaagaagttgaatctctgaatggaccaataacaggctctgaaattgaggcaaaaactaagagcttaccaaccaaaaaaagtgcaggaccagatggattcacagccgaattctaccagaggtacaagcaggagctggtaccattccttccgaaattattccaatcaatagaaaaagagggactcctccctaactcattttatgaggccagcatcatcctgataccaaagcctggcagagacacaaccaaaaaagagaatttcagaccaatatccctgatgaatatcgaggcaaaaatcctcaataaaatactggcaaactgaatccagcagcacatcaaaaagcttatccactatgatcaagcaggcttcatccctgggatgcaaggctggttcaacatacacaaatcaataaacataatccagcatataaacagaaccaacgacaaaaaccacatgattatctcaatagatgcagaaaaggcctttgacaaaattcaacaacacttcatgctaaaaactctcaataaattaggtattgatgggaagtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattttatatctagaaaacccgatcatctcagcccaaaatctccttaagctgataagcaacttcagcaaagtctcaggatacaaaagccatgtgcaaaaatcactagcattctaatactccaataacagacagacagagagccaaatcatgagtgaactcccattcacaattgtttcaaagagaataaaatacctaggaatccaatttacaagggatgtgaaggacctcttcaaggagaactacaaaccactgctcaatgaaataaaagaggacagaaacaaatggaagaacattccacgctcatgggtaagaagaatcaatatcatgaaaatggccatacagcccaaggtaatttatagattcaatgccatccccatcaagctaccaattactttcttcacagaattggaaaaaactactttaaagttcatatggaaacaaaaatgagcccgcattgccaagtcaatcctaagccaaaagaacaaagctggaggcatcacactacctgacttcaaactatactacaaggctacagtaaccaaaaagcatgttactggtaccaaaacagagatatagaccaatggaacagaacagagccctcagaaataatgccacatatctacaaccatctgatctttgacaaacctgacaaaaacaagaaatggggaaacgattccctatttaataaatggtgctgggaaaactggctagccatatgtagaaagctgaaactggatcctgtccttacaccttataggaaaattaattcaagatggattagagacttacatgttagacctgaaaccataaaaaccctagaagaaaacctaggcaataccattcaggacataggtatgggcaaggacttcatatgtaaaacaccaaaagcaatggcaacaaaagccaaaattgacaaatggtatctaattaaactaaaaagcttctgcacagcaaaagaaactaccatcagagtgaacaggaaacctacagaatgggagaaaatttttgcaatctactcatctgacaaagggctaatatccagaatctaaaatgaactcaaacaaattgacaagaaaaaaacaaccccatcaaaaattgggcgaaggatatgaacagacacttctcaaaagaagacatttatgcagccaaaagacacatgaaaaatgctcatcatcactggccaacagagaaatgcaaatcaaaaccacaatgagataccatctcacaccagttagaatggtgatcattaaaaagtcaggaaacaacaggtgctggagaggatatggagaaataggaacacttttacactgttggtgggactgtaaactagttcaaccattgtggaattcagtgtggcaattcctcagggatctagaactagaaataccatttgacccagccatcccattactgggtatatacccaaagtattataaatcatgctgctataaagacacatgcacacgtatgtttattgcggcactattcacaatagcaaagacttggaaccaacccaaatgtccaacaatgatagactcaattaagaaaacatggcacatatacaccatggaatactatgcagccataaaaaacgatgagttcatgtcctttgtagggacatggatgaagctggaaaccatcattctcagcaaactatcacaaggacaaaaaaccaaacaccacatgttctcactcataggtgggaactgaacaatgagaacacatggacacaggaaggggaacatcacacactggggcctgttgtggggtggggggaggggggagggatagcattaggagatatacctaatgttaaatgacgagttactgggtgcagcataccaacatggcagatgtatacatatgtaactaacctgcacgttgtgcacatgtaccctaaaacttaaagtataataaaaaaagattatcatttaaaagtcccagatttagtttgcttatagacttttgtccagtagagatgcaaatactttctgttcagaagagaaaaataaccccaaagttataatttattgtcccgtgggacagcaagcagatatgcatctcatccagcaaatattattctgaaatgcctttattaaactcccagtgaatacacaactcttcaaatgctctctagtctgtttgtataatagtttgtaatttcaaactattataggctaaatcaaatttagccttgcttcgctcatagattttttttgtttagactatgttttaggttccaggttttgtataacattttacataatatattgagatagttcctactcttatttttgttttataaatgagaatgattgtgttttaataaggttaagtaatttcccaagatcacgcagttagcaaataatggatttagattctgactcaaggaattctgacttgagatccttctgatatacctccaccccatttttgagaattactgctctagaccttttctgaaaggaacctagactgtttatatctaaacacacaactaccaagtatctgtgcaattcaggtcagaaattacataaagttgcagatctttgaataggaatgtattcaagaaaatagctttttattgaagagggctagatttttaaaaatctgtaagagttaatcagagcttagcgaattgatgattttcctaaaaaataatagaattagacttcccaatgttactagttatcttgataacaattttgctaaaaattcaaaatccactgacaacaataattatgtatgcttgtaaaacaaaaaagccatattctgacgaaatataccattggtaataagggaaaattgctcagtttttattctcattaagtctcaagaaagtctgagtgaggaaaactttaattggataccacttcatttggtaacaccattaattggacagttaacaactttttcaaaaggttgataagtaaattggtcatggtagactaacttatgctgtttgaaaaaataatccccaaatctcagaggctaaagtaacaaaagcttatttcttgcttataagacaaagctatcacgggttcactagaactacattcttcggatcattgtcctccctttggacctggctgatgatgtattaccaatgtccatatcagcaaaaaaagtgagcctgcaattctctcatgagtatttaattgctcttcccacagaggaacacgttacttccagccaacttctccccttagtgaaaaatattgacgttgcctcaaccaaacagaaggaagctagatgtaccgtcatactgttagcagcgggtctttgctcccagagcccccaagatggcagcaagcctcttgcactctgacctggggttcttggcctcaaggattccaaggaatagaaccttgggccatgcagtaagtgttatagctctattagaagccctgggtcacggaagagaaccatggaacccagcgactagtgttaagctagattaggatgaacctgggcacttagctgcacagaataatggcgagcctctagcccgatcaggagtggcattaggcgccttgctggattagaagcgcagcagacaccctgcccgatctggagggatggaagtaagcggcaggtctgcaacgcagggatcagtagtggtggacggcgagtgataactcagctccagctggaacaaacatggaccagcagagtatgcagttgcatgatttaatagagtgaaaacagagctcccatacaatgggaggggacccaaagggggtttcccactccccacttaatggctggggtttatatcccaatcattgtcccttcccctgtgctctcagatgatagatgatgtgactatttctttacctcctgtttttagcctaattggtgttttagtgagccctctttactacctgattggttgggtgtgagctgagttacaagctccgtgtttaaaggtggatgcagtcaccttcccagcaaggcttaggaattcttagttggcctaggaaatccagctagtcctgtctctcaatatgatatgtctggaaagaggggaagtgggatatttggccaaaagagttaaaaaacactgcagtgagctgaatgtttatttccacctcctcacccgcccccaaattcatatgttgaaatcttaaccttcacagctgggtttaattgggaggtgagacttttaccaaatgattaggtcctgagggctttgctctaatgaataggagtattattcttatgaaagaggccagagggagctcatttgaccttttcatcatgagaacacagtaagaagacagctgactatctatgaactagaaaatgggtccccaccagacatgaatttgctagcatcttgatcttggacttcccatcctccagaaatatgagaaataaatttttgttgtttacaagccgtccagtttaaggtgttttatatagcaacctgaacagaccaagacaagtaccacaacatgaaatgaggtgattatgtatacctatattaatatacatctattactatagagtacatcaatttcttgcatatttctgcacatgtgtgaaaaaagagtcacatgaaaagtcttatctttgtaaatatacatatgtgggaatgtgtaaacatgatacaactgtgatacaaataatatagactttgaaagttttcataaatgaaacgcttgttttccgaaactttgtccactgtaataatgttctggcatttataaaatactgcatgtgaggtttttaataattagtaaattcacatatgtgttttaaataacatagtaaaataatctttttaggtaatgtggaacaaattgtgaaaaaaatgcaagagtgaagtagaaatgataaaaataaaacataatttaattgttgtaagtgctttgagtaagggatttatccaaaattggatttcaaactattataggctaaatcaaatttagccttgcttggctcatagactttttttgtttagactatgttttaggttccaggttttgtataaaattttaacttggagaaacagccctagtcaccattaatatggtcattctaagttttttggatgtttcaaaattatcgttatgctaaaagtgcatttgtattatatttaaatgtcttaagttaataggtctgaaaattatctgtatatagacatttaaaacaaatttagaaattattatactggtataaaaagcacacttaatactatgcttcaattgaaccaattgtcacgttttcacttccaagaccccctcccgcttttcttttttccatactgagttctgttcctactgttctgagaaagctatgctcttactgttttccaaagctgggcctccatatttgtgaacatgccatatatttgtcactccattctaaagagaatgcccgattttcctacctattacccaatttgctgttttcccttcatcatcaacataatgtgtactctagtgagggggtggctggaggccaggaacttggatggagctggaggctgttatccttagcaaactaatgcaggaacagaaaaccaaatactgcatgctctcacttataagttggagctaaataaaaacatatgaacacaaagaagggaacaacagacactgaggtctaagtgtggagagtgaggagagtgaggagagggagaggagcagaaaaataactatcgaggactgagcttaatacctggctgatgaaataatatgtacagcaaatcactgtgatgtgaatttacctatgtaacaaacgttcaagtgtacccccaaacctaaaacttaaaaataaaacaaaacacaaaacctgtactcactgctttgatttttaatttcccatttacttctcaactcatgacaacatatctttcacctctaatgtttaaattgctctaacaaaaatcatccaatctaatgattacaaaagtcaagactctctgctaatcctgacttcattttgggatcaatgcaataaatcaatctctccttgaagttaattctcccctagttcccatgacattcccattccaatcttttgctacttgtttatttactttcactgtgtcaacttcaatcacacacttcttaaatgttactgtttctttgggctgtaatgtctgttgtcttcttttcattaaattattgctaaataataccaaccagaaatcaatgttatttataactgatatgacaatgactactaacttgtgtttccagtcctaactgctctcattaaactagatctatattttcagtggccacttagttatctccacatggatgctctacacacatctcaaaaggaacctaccaataaccagtctgtttatcctactttctcctcacaacctgattccatatatttaatgggctatgtaagaattatttttttcttatttcatcctcatcagtcgactcctttgagagtgtttgaaatatttctcaattctttcattttcctagacttttgtgtttttgttttattttctcccctggagatcaatgggcagaccagaatagttttattacagttcaatggcatttagggaaaggagcaaatcatcatattcactgtgacatcacaaaaagaatcacagaaatcaagaggagtttcatagttgatatttaagaacaccaagaactttccctatatcctcactcaggattctctgcttaatgaaatgtgtaagagcacagagaacttattaaatatttaataatatttataatatataataatataaaatatattatttcctcttaaaatgattaacatcatttattggtatctaagtttttaatataaaaattaatttatttgatctcctaatttcttaaagatgccaaatacatggagccttcccctgatgtcctgatggcagaatcccattttgttacaccgtgggtggagagagcagatgccccagtgcctccttgcagctttggacacaacgtgcagatggcatcattatctcttttacatcttggatggattgctgggaaggacattctgttaaatagttattttaaaagatcatttgggaacttatgacttttttttttgctatttccttatatattttatgactaacatatattgttatttttaatttttttctgagttcattcccttagtttatcatgttaaatttctctaaagagtagtagttttctttcatttattcagaatattatattttcatatagagggagatccagcacccataaaacattagaaacactcaaaaggtaatttacatattgttttttaagatttttaatattattgaaaatacattgtggtcattttattgtccatcacaaatgaataaattcatacacaaatatatgataataaaaaatgctctacaagcaggtagaggagtgaaaggactccatgtattcagctaaagactttgagccagtatttgcaggtaagtatcataagccaaatgtctcaaactttagcatgcatcataacatctggagggcttaaaaattcagcttatgttacccatcccagagtttttcattcagtgagtctacagttgggcgtaagaatttgcatctataataacttctcagataaggttactgctgctcaaaatgtgggaactactgcttgaagtcacctatagaatatttggaaatattgaaaaaccaaaagcaacctgaaactagcaaatatagttaatacagacaataatactaataaattgcaatgttaagatatcaattattttaatgctttcatgctaaaaggactaacagaacaaaagtgtttaatgatcaaaataaaacaaaccttttggaagtaatagatgaaaacaaaacctttcatgataacattttgtgttgttttaaacgtacagaaaagtgcgaattaccttcaaaatatacttcacaaaaaggtcccctgcggtgtagacattggaaaaggtcaaaataactattttctctaaatgcttatcatatttgttgctttcacctattttaggtgacacaatttgctccttttttagtgtcttatttccctatttatggcactaccctcacccagccttccagctagtaccacaattctttttttttttttttttttttttcgggacagagtctcgctctgtcgcccaggctggagtgcagtgggctggagtgcagtcacgcaatctcggctcaccgcaagctcggccttctgggttcacaccattctcctgcctcagcctcccaagtagctgggactacaggtacccgccaccacgcccagctaattttttgtatttttttaagtagagacggggtttcagcatgttggccaggatggtctcaatctcctgacctcgtgatccacccgcctcagcctcccaaagtgctggtattacaggtgtgagccaccacacctggccgctagtaccataattcttgtgaacactgactggcactctgaccatcatttttcccaatttatttagtttaaataaatcacgtgttttgccaattgtagttggttatctgtgtgcttttctttcttcttagcttctgcctgtaccttccaatatttcttctctgaagtaaattaaagaagaaccctcacaatatcttctataatgctgtaaaaaatagcattttaacgtggcctttatatactcactcgtttcttagaaaacaagttggcttatttcagtttgaaacataagtaattgatccttaccaaacaggattaaaaatagtagcaactgtaatagaaattttgatattgaccacataacaatcttatcttactttacagattagtctaagatgctaggagttgcaaagagacttaacaggcttgaatggatataatctgtacagattctgatctttatctaaaaaaactgatattcaccctttgatgcaaaaaagagagagagagataggtttgcagagtgggggaaagatgaagagagagagagagaaacgacctcagatttgggcttgtgtaagagttttgtggaattcagtgactgaagggccctggaccagttctttgaatgagagtactggggagaaaagggggctttgagaagtgattacatgaataatgaaatgaattttctgtaatgttccttaagacacaattaagtgattgcatttatttttatttgtgcaatggactgtgctttaataagtgcaaatctctgcagagccttggttgcttgggcctcaggatttataaaagctatgtgttttttatttgttcttaaaatgacattttcttgattttagttattttcagaatgttgagagtgggaatgaaaggcaactttagaatcagaatttgacagtagtaggaaaaaagtgataattatactgacatggtcaaattcacaaaatgttcttaaccttgtggtacttaattttgcatattgaccaaaaaaggccttaacattcttctcagcttaacgttagataggttgtttaagttcctcaccttccttttcttagagcaattaacatagagaacttttaactttctagcctttgacatgtaaatcttttaaaaactcttataagctttacaacctaggactaagtttctccaggatccgggagccacccttttgaaatataatcaccatagagataatgccctgatctccccgtctctaagggaaagtaggagcctaactttggtgggcaccttactccaagttgtaaaactccctcctgtcatgaagaaagtctatttttccttagggtaaagccaattaacaaacacagatgactcgtggatccttctcgccctcatttttaaaagatcgtccacgctttgtcttagaggagttcagctcagactgagttatggcctctcccctatttcaacagccttgaacgaagtctacattgcctgattaactttgtccagtgcattttttactttaacaatatgaagtggcccaaaataaataaataaataaataaataaataaataaataaataaatgaaaaaaaaacgttaatagcactagaaaaactacaggcagaaccgtgttacgtttgacctttgctttattattattgcattcgcacagcttcagttgtttacacttcaaaacatagagtatgagacattttgcatttctgtatttcactacaccacagtcaggatcttttgtgtccccagcttccaggaagcaggaaaatgcaatcttgcttgttttaggaactacccttcgtctgctaacaagggcttatttaagaatcttggttgtcctagtgccaaaaaatggccaaagacataagtacatttcatggagaatgctgtacttttgttcccaggctctacattgctcaggaactcaggtttatactatttttttcctcaggagttactccttcaggtatattaaggatagtaactcacagtagaccctctccttcaccagcagcctccctcccccaccctccaattctaaatgataagtaaaagtggagtcctagactctgctgctggaacccatttcttctcccaatattggaaagacctcaaattcattcccagacctactatttcctcctcccacaggaagaaagtactttattttgcattcattccctcaaggctagaaaaacttcctcaaatttattctactttcaagttctaaaacactgaagaaatgtatctacttttttacctggaggagggttaaggaagataaagcgtcagaccatctgccatggtctgaatgtttgtgtctccccaaaattcatacattgaaacccagtccccagtgtgatggtattagaaggtggagcctttgggagaggattaggtcaggaaggtggagccctcatgaatgaaacagtacccttataaaagagaccccagagagatagctggcatgttctaccatgtggggacacagcaaggagccatttaagaaccagagagagagccctcaccagaccctgagtctgttggcaccttgagcttggacttcccagactccagaactgtgagcaacaaatttctgttgtttataagccgcccatgtattatatttttgttgtagccgaccaaaagagctaagaaccatctttttgagacagtatgttggtgtgtcatttcagggatgaggaaggagcttcaacctggttatattttgtttttaagacactctaaactgatgatacaatttaatgatgaaaataacagcaaatacacatctgacagttctgttgcaaacattatcctaaggcttctcagttgtgtattataatagaatttaaaaaaaaaccaaacatagttttagaagagggagacactcagtgcataagaatatggctactaatatattcctgctcagtgtttgaaaagtattcatttcccctgatatgcacatgattttctacatgtccaaaaacaacattattattaagtatgttgatagaaaaaaaacaataatttatgatcacctcactgtaattgcatacaaaaattaatatgtggaaacccaccaagaagaagttatgtatcttcaaagcgcaattattttattgaattcttagaagaaattaaaatgaatatggcattttattactgaattattctggttttagatcatacctagatacctttaaaggaaagtcatttcgtagctgtgtcttccagaggcttttcaaatatatatttagcttgtgagatttttcttttgaataacctttcccttttaactgatgccctagtctctgattacccactccctggcctctgcccttttctcaaatcatcttactcagcggtaatgaaacagcagccacagaacagcagtgttgcaagactcaaatgcattagcctatcacggaaaaacacaagacctttgtttagatacaagtacgtacaatctgagttctcttttttcccctgtcatgaactctatatatcttgatgactttgaaaactaaactttcttccccttttcttagactaggattctaatttaggtataatgggatttgaacctccctcaagccttttaaagtattcaagggaggcataaaagaaatagcagagagacattcactttttattactctctatgatggggatattgtattgctcacatactaatgtaaattcctctaaaatatataatttcaacccttttattctctcactattccctttccactatcaatttggatttctgagaccttacgcaactaaactaaatcgtttcctgaagcttatgtgccttggtcttttgagtacagtaactgcacaatcgacagaagttacaactaataaatttctctttgtgactcttcctgacaaccagaaaaaaacagtaatttaacttttctggttaaacttgaaccaaggcctaaaaagtagataagtgactcaaactatttatcttactactcctaccctataaccctcacagggaaatgaaatattgccagcattctaaaacttgttgaaagggaagcattcatatttaggaaaaagttacagatagagatcattaaaatttagaaacattccttttcaacttccgcataacttctatctttatagttagtcttgctctgcttaaagctatactgaggaatgtattttaaatttagaaccaattttaccctttcttttataattcaaaaagttggaatatttgttttaataatttctgtaaaaacaaaatgccatagaatttcatattcaggatattagtatatacctcactatcttgatagactcttttagaatcttctcactcctcacatagagaaacagtgcatagacatccaggacacagaagcgactgtaacaattattttgataagacatatatgagatggaagatgaacattatttatgttgaccatagggacagcacagtataattgagttatgataacactaactccttcatcatgtgaacagatgctaagaagcaacatgttcaattactatttgaatacattatctcattctttgcccttaataaaatatcctagtgccacaatttcaaaatgagttgaaactttgatgtactgctgccaacagccacagaacttttaaaagtcactgtctagttattttgcctctaacaaggaaacacatttgctgagaattagaatgaattaatattatacttatcgagactattcatgataaagctgtctcttcaggatctttataaatgatcaacctctcctggatgtgatattttctgctaaattcagaaataatcagaagagacaatctttatctcattgatatcaatgctggttttaatgcctactacagtacctacagacaactaaaccacattcttacaatgttttaatgatgcctactatggtacctaaaaacaatcaacattaggaaaaagtaacagttaaataaatagaaacctgtactttgcactattagaaaaatttatgttttaaataaaatcagcatgtaaattaaataatgaatgcaatatgtgttctaaaccatgctacaatttaaagatttaaacaaatgtgttgagatgtaactaatagaaatacaatgaagcagttcacatacttgaaaaaccaaaaaacttaataaaaaatatatatgcagatgacatttcttgactagtgatacagagaaatgtcctataaaagttgcatagaggcctatgaacttcaataaatatttaaaatctattctttactgagaatagatcttatcataaatttatccatctcttttattggcagaggagagaagcagtacaaatatccttggaatgctttacctttttagcagagggcagctgatacatcatgtagagaattgttcaataggtgctctgagaagacaaaatgtccctatttctttgagactttattcactaatatttcaatttggcaaagtgtgtccatttttttttcttatgtgatgggaagggatttaagaactttattttataagtcaggatctctatttatacaggaaaagtacaattactgtcagtaaaatgaaagtcttctatattcagctggcaaccctaagaggcagttcagagagtttcttaaagcagagaaaggtttaaaattatgaagtgatggatatactttatccaaattcctgctgtcatatttactattatctttaatataccaacacactgttaattgcctaaggaatagaaagtccttggcttatcttgctttcttgcctgcatagaaacctcttaaaactatacttttcttttatctgttatgcctctaacatttctgtcattaacacacacacacacacacacacacgcatatatacatacacacacacacacatatatatacacacacatacatatacttacacatacatttctacgtttggggctttgttatactccaattgcttggagaaaaaaaaatcaaagttttaacgcttgaaaacttttgccaaactttctttttccatatgctctaccattagggatttctttattttcagggactcaaaagtttatgacactccagccctgacctgacatcatgctgaaattgtcaataacccacttttatttctactgttgcccaaatcaacatgtccaacataaaatttgttttgccatccccccaaattctaatacaagttttaattaatggctgtaccacattttagtaatgctaagctttaagcatttttggctcattttttctatcttaaattttagtcagattccaagtcatgtatagtatacattcaaaatgtcttaggcttttgctccccaccttacactcctacactcggtatcttctatcatgtaccatctgttcactataatgtttcctaagtattttacagctgtcttccctgacttcagttcttaataaatgcaatagcaaaataaatcttcctaaactaaagattctggtcatatgcctgtgattgcaaacctttcttttcgtttttcctgtttctctttttttttctttttttttttttttttgagatggagtctggctctgttgcccttgctggagtgcagtggtgcaatcttggctcactgcaacctccacctcctaggttcaagcaattctcctgcctcagcctccagagtacctgggtggttacaggtgcccacccccatacctggctaatgtttgtatttttagtagagacagggtttcaccatgttggctaggctgatctcgaactttacctcaggtgatccgcccaccttggcctcccaaagtgctgggattacaggcatgagccaccacacctggcctgtgattggaaacttttctagggtaccatcacatatggaattaattacagctttctctacctatcctgtaagtactttacctgcactatggtctcttagaaagttacttaactacttaatcccttagttactatttgtaaaagggaataataatatgaaacttttagacatgttgagaagattaaatggctctctctctctccctctttatatatatctagatatatctatcgatatatctattgatcgatagatctatatatggacagattctatatatctagatatatatcgatagatatatatagatatacatatctatatatatggatagatctatatatagatagatagagagagagagggagagagagagagccatttaatcttctcaacatgtctaagactttcatattattattcccttttacaaatagtaactaagggattaagtagttaagtaactttctaagagaccatagtgcaggtaaggtacttacaggataggtagagaaagctgtaattaattccatatgcagtggtaccctagaaaagtttccaatatatctatatctatatccaatatatctatatatatatatctatatatctatatatatatatagagagagagagggagagaaagagggagagagagcaagaagagaggagcattataggtactcaaaaattgacactttattatctacgtttctgacctcactttttaaaataacttattcttttgatttgtttataattgttattacaaataattttcaacatacataaaaattttaaaaatagtgcaatacataccagtaaacctacaaccaaaattaaataactgttaacattttgccatacattttgtatatatatgttgtcttagtctgtttgggctgctatagcaaaacaccatagactggtagcttatgaataatagaaattcttttattacagatctggagacagggaagtctaagatcaaggcgtcagcagactcagtgtctggtgagggcccgcttcttcatagatggccttcttttcactgtaacctctcatgatgacaggagctctctctggtctttcatagcacgaattcctttcatgagggctctgctctcaagacctaatcatctccgaaaggtcccacctcttaataccgtcaccttgggagttaggatttcaacatatgaatcaacgtatgaattttgagtgggcacataaacattccatccactttatatgttaaagtgcaaatgcatgctttttgaactgtttcaaaacaagcggaagacactttaataaagcagatgatactttatccttaaatactctaacatccatctgttattaataatcagaatattctccatgctgcctaggccattatcacatctaacaatattaatcataaatattgagtattagctattatctaagtcttatcacaatctccccaactgttcctttaatgcatttcataactgttttgccttcagtttagtgttattttttaaccaggatgcaattaagtttcatatggttgttagaaatgttctctctctctcttaatttaaaggagctctactggttttttaaaaaaacgcaatgctactttattaaatatctgaaattatggattttaccatttgctaactcagtttttctaaactccatatttctgccaaattggaaattagatctaagaccaaattaaatcatgttagccactttcggtaagcatctttcatgagcttttcataaaatattacatcaagacaaatatatcatggtgtcttaaaggtagtaatgctaaatttgactgatgatttaagatgacctccatatcactttattttatagtttggtaattttctttgcaattagaaaatatgcagtgaatgatacttttactatgttggtttatgaaataaaacatttcttctaaaagtttcagtatccactgagggttctgtaaaaatcaactatttagttataaattttaaaaaaatgtctaattctgtcattttcatacataacaaaatggggtttcttttttcacctcatcaaatcaatatgaactacaatttgtcttaaaaagagaaggtaaaaaattatctccctttaattactaatgctaagaacaaggagttgatatatacctactaggtatacacaaaatttaaaagtaaaaaaaaaaatgactataaaggaataagcagttgaagtaatagtaattttcaaagatagtaaaactttttcctctttttattttagtaacactaagaaatcaggatttttcccccttgctgttttatatttacttatgcccattattctttctcatgctcacattatgtcatatttggccactgagtccattcaggctggctcctgtgtccttttgtcacatctctactagcttttgagtatcaaaaagagtctggcttacatgtactactttttgtcctcaaaatatattgtacttacttactatttttgatactcaaaagctagtagagatgtgacaaaaggatactgtgttaaaaatcattgagaatacgccaggtgcggtggctcacacctgtaatcccagcactgtgggaggccaaggtgggcagatcacctgaggtccggagtttgaggacagcctggccaacatggcgaaaccccatctctactaaaaatacaaacattagctgggcatggtggcacgttcctgtattcccagctacttgggaggctgagacaggagaatcacttgaacccaggaggcggaggttgcagtgaaccaagatagggtgactgcactccagcctgggcaacagagcgagactccgtcttaaaaacagaaacaaaaaataatttgaaatatttttttcactctgtagttttgctatgaacttaatacaagttgtgtttatttgtttagtttgtttccaatttcacaattcaaacatatcattttgaggcctgcacagtggctctcgcctgtcatcccagcactttgggaggccgaggcgggtggatcaattgaggtctggtgttcaagaccagcctggccaacatggtgaaaccccgtctccactaaagacacaaaacaattagccgggtttggtgataggcgcctgtaatcccagctgctcgggaggctgaggcagaaggatccctagaacctgggaggcagaggttgcaataagcaaagattgtgccactgcactccagccttggcgatagagactccctctcaaaaaaaaaaaaaaacactttgattttttaaaatgtgttcaatatgttatacacttacataatttaaagtttatatattcataatctataaaaagctgtactataaaaagttacactttcatttctatcctcttctctgcagtctctaccccaacttcacatcttgtagagatttccctctttaattagtttctggtttatcgttctgatggttctttttttttatggatgtatgagtgtattgttgggtatgtttgtaagtgtgtatgtgcatatgtgtgtgttgcccttccttccttagaaaaaaggctgcatagcttttctcgggcactttatctttttggatatatatagcctaaggattattcaagtactccataatcttccttgtgctttttacacctccttattacacctttatgtagctttatttttttcccaccaagtcaactattggtagtcatttggattgtttccaatctcttaccattatatataatactgctgggaaaagtctaatgcatacattgattctatctgtagaaccgcattttcagtatagagtcctggaagtggaactatgagtcagtggttatttaatgtgatcatgttaaaaacatgaccaaatttcccttgatatgattaaataagtctccacacccaactgcagtgtgtgggagggcatttacagctttgacaactgagtgtgttgtcatcattttggttatttgctggagatataactttaaaaatatattttaataccattttaattattttttctttattatgagtgagataagcgtattttcacatgctacacacatttactttctttttctgaacattttatgcatgtattgtaacctttttattctaccagaactctttttatatcctagagattagctctttgtcttaagttactttctccccttatataacttctaactttactcttatctcttctacaacaggtatcctactgtccaggccaaatttttacatagggaaaataaattaggttccacatgtgtcaaaataaaataattctttttttgcattaaaataaaggaattattttttaaacctagatgatggaaaaaaaaacctattcaataaataaaacagatagtcccttaaacataaaataaagagggtttgggaaagactatttgtatgccaaaagtgagtgatgaagaaaggaaaagcttaagaaagcaatgggaacagactgccttagtagtaaagtggagaggggtccacctccagagtgccagcatgagcttccctgctgatgccatccccagtgaaacgaccataactggtaaaaactataacaaaatgatcattttatgttctacaggcaggaatacaacaaataaggaaacttttgtttaagaaaatgtactaattcaaatgagtgctgagagtctgtgacacttgaaccacaacccattaaccacaacttccagctgactgtgttggaatctctactttcagtgaatatggctgagaagatgaagctaactctcttctcaactcccaatcaacagatattgtatctcactggaaatggaaaggccaccagcatttatctgcttaaacgttgagttgcagaggttaagatcctggttagtgtgactaagagtttacggcttccttttctacacccaaccccaactcatagggcagaattatttaccttagtttcagcaggccaagaatatgtggagaccgattaccttagccctagtttgcttgtactgtgggggtttcacatgcagagaagttcagaggctctcaccttcacgcagggcctggaggagtgactcagagattttgccccggggaaaacacagtccataaaacagagttcccaaaccctctccaagaaactaatttttatttaaaacgtaatgtgaggtagtgcaaaaccaaaggcaatcttgatgacaaagaaaattttgggggtaagtatttaagaggaggctggtatatatagcagagcaacaaactaatccttaggccaattagcttactggagagaaatggggaaaaaagcagctaagaagagcctgggacaggaggaaagtgttaaaacatatctcaaatactagcctcacaaatgactactttggctattggcacagtagtttatctcagaattactgtctttaaaaatctggagaaaatataaaaacataactgaaggcaccagaacatgaccaaagacaggaagaaactgaagaagattcaacccttgaaagaagagaattgcacctagtgagtagaattttttattgtatgactattgcttgagggtaatttctggtcccccgtgcccttttgtgtttgggttgctagagatcaagtacaaagttgcaatttcactggcttaatagagtgtgacaataactgaaagaataactaaaagatgaggggggaaaatactagggcaaatactagaaaggaaacagctgtttgatgtagctcaaaatgctacaatttaggtagttaggcagttagacaggcatgagtggggctggcgagggctcttccctcgtccactaggaatgtcaggtgatggttccgcaatgatcacctggcctcgctaaaagtgattcacggccgggcgcggtggctcaggcctgtaatcccaacattttgggaggctgaggcgggcgcatcacaaggtcaggatgttgcgggacaatcaaacaggagagaccgacaaggttaaggagagcgctttattattaaggtgatcaccggctcagtcagactagggtccaatcaccttttaagctgtttgtggcgggagttacgtgctacgggaagagtacttgcagaagcgagaacaaaggcagttaatcattcttttacatttgttacaccacatgtcttacatccttgggaatacatgtttttgcaacatttgcttatcatccttgtgacttaacagctgcgctagggagagaagcaagaacacgccgtgcctcaaggaacgtgaaatgatagaacacagataagcctctctgggcacagaggagaaacaagcagttaatattctctcaacccaggcccccgggtggggctatattgcattctacctttaaggaaaagaataaatttcttggctattataaaattcattaattttcccttcaaggagatcgagaccatcctggctaatagggtgaaatcctgtctctactaaaaatacaaaaacaaaattagctgggcgtggtggcgggcgcctgtagtcccagctactccggaggctgaggtgggagaatggcgtgaacctgggaggtggagtttgcagtgagccgaaatcgcgccactgtactccagcctgggagacagagggagactccatctcaaaacaacaaaaacaacaacaacaacaacaaaaagtgattcactggcagtggcaccagagagaggccaattcctgatggtccacactgttgcacgaaagtgttaattggatgcaggcaccagggagatgcaacttcctgggcatgttcattaagagacaaaatggcagagtatgaccttccaggggcagttcatcagaaaagtgaagaaagcctcacatggacatgcctacaacttcctaaacacactgtgcgccctcaccttccaagggtaaggagtactttgcatgcaggcagcccaccctaagggagtagtattgagaaagaagacagtctgtgaagtcttaggatcaaggttgaacatcgcacttggccttcacatacccacttggatttcttccaaacgtaccttcctttttttcctgttctaaagaacctttttaaataaacttccgctcctgctctgaaacttgcctgggtctctgtttctgccttatgctgctcagttgacttatttcttctgagaaggcaagaattgaggttgcttcctgacccatatggattcacagccagtaactcggatacctaacacccctaagaaaaatctttacccagctccttaactaatacagaaatagttcatgtataggagagagcatgaggatatagaaggaagcagtagccgcaaggctgagagagcccagcagagactttagctgctgtacactctagggaaggcagagtttagagtagtaatccttccatgtcatctgtctgctaaaggcagaatcaacattctttataaaaagaatccaaaggctcaatagcctatcattcacaatccatttttttaaacatggaaagaaataagaaaatgtgatctacatgttaattttgcactgagctcataaatgttttagccatttctgatagcagagaaataattaaaaggagccaatatcaatatatttaaggagttaaaaaaaaggctagggccacatgaattaacagatggggaacatccatggataaatagaaactataacaaagcaccaaatgaacattttaaaactaaaatttgtattatctgaaatgaaaaatttattgaatttgcttaatattggattagagaaggcaaaagaaactatcagtgaaattgaagtcatataaacagtaatttataaagtactgaaaatacaggagagaacaagtttgaaaataaaatggagtctagatgtcctaggataggagataaagaatagggcagaaaattgtacttaatggctgacattttcccaaacatggtgaaaagtgcaaattacacacaaaaagctcagcaaatccaaagaattaatacaaagtcaaaattgcaacttaggcatgttagctcaagttgctccagtttgtacaaccccaccattgtgcagaccgtggtgagagtggaaaattccactagggttgggaccatgagaaacatcctcctggacaagtcccaggcctaaccgcctgaccacaggaaattcctccttatcagcagccaacctcgctgcccaccccatttcacagtaagcccagagcttcccccgccctagtctgtaaacgaaggcaggctcctgcactagctggtgtccgcctccgcaggtctttgttcaataaacctgtgttgctgttgagctgccaactctctcactctttcttttaccttcaccttcgtttcagagccttacaatgcatatcttaagagataaagaaaatatcttaaaagcaatacaatatcttgtattctatacaagagaataactgtatgaatggtatctgacttccggtcagagaaaacaaaaaggtaggctggaagacaatgaaatgatatcttttaagtgctgaacaaattaccatgaacaacaacagaaatataaaacctgtcagctcagaaatatgttatccatcaaaaatatttttaaaaaatgaaacctaagtaaaaaaagatatttctgaatacaaacctcttattttctttgagtttcaataataattcatttcagtggacctgcatttcagtaaatgctaaaaaaaacacaactgaagagaaattatactgaaaactacactaagaataaagagcaccagatatggcaaatttgtaggtaaagtcttatattttctccttattttttaaaatacacaatttttaaagcaacaattataacacataattataggaaaaaaaatatatagagagagagatatatatgtatatgagtggacacacacacatatacactataacataatggcctggtaaggatatggaaatatagtatgacaagtttttgacattttataagaagtgttacaatattaattctaggtggactgcaataaattaaagattcaatcccaaggacgttaataaaaatggaatgtataaagatatagtcaatagaaaaattaaaataagatattaaaaactttcagttaactgaaaagaagacagaataggaagtaaattatcaataccagatgggataaatagaaaattaataacatgataaacccaaatccaaccatataattgttataataaattaaatggcaataaactaataagtgcatataaaaggtagacattttccaaatagataagtctcaactacagactaatataagagatgtactttaaatataaaatgttgaaagcaaaggtaaaagatgaaaagcagtatgttgtggaaacaaaaagtataagaaatttggcctgattataataatatcagacagaaaaagtcaagatgggaaacattaccagagataaagaaggggatttcataatggcaaaaggaaaaatttatcagaaaaatatattaatcctaaatatgcacatacttaaaagaataattatagttggacatttcaaagattctttataaatacttgatttaaaaaaaatctcaaattcttattaatgatacagaagttgtgaattaaattattaaccactgctatcatttgtatgtttgtctcctccaaatttgatccgtattgttgaagttgggatctgatgggaggtgtttgggtcatgggggtagatccctcatgaatagactaatgttttggggtggtggtgagtgagttccaactctgtagtttccaggagagctggttgtttaagagtctggcacctccagtctctctcttgcttcctctcttgccatgtgatctctgcacctgctggctccctttcacattcctccacgagtggaaacagcctgaggcttttgctagaagttcaagcttccagccagcagaatcttcagctgctgctggcatttttttctttataaattattcagtttcaggtatgcctttatagcaacacaaatttacttgtaagagacccacactcagtatacttcagaatacactattttttcaagtacctttgaatcattatatattttcagaattgaatcaaaataccctatcttttcaactacatttgaatcattaaccaagggtgataacatgctgggctacagaatatatctcagtaaattgtaagagtttgaaatcttatagagtatgttttctgaccatgataaactcaatggaaagcaataaaaataaagtatggaaaaaagtcagacatatttggaaattacacaatgcacttctaactcacccaagagccaaatgaaaaaaacaagagaaattagaaaatacttttaacattaaaaacattaaaaaaaaacaggaaactgttaaagcagtgcttagggaaaaaattacagctttaatagcaattatgagaaaataagaaaaatttaaagttaatgacctaaattcctatctgtaagaagatagaaataaaaagataaatttcaataaaatagagggaagtaaatacacatcagcaaataaattatttaaatttctaataagagaaatcttttataaataaaaatgttgattttttgaaaagataaatgaaataaataaatgcctggaaatactgatgaagtaaaaaggaaataaaacaaacattaccaatatgataaatgaaatagaattatataaatattaaaatgattataatagggtgagcgcggtggctcacgcgtgttatcccagctctttgggaggccgaggcgggcggatcacgaggtcaggagatcgagaccatcctggttaatgcggtaaaaccccgtctctactaaaaatacaaaaatttagcgggccatggtggccggcccctgtagtcccagctactcgggaggctgaggcaggagaatgacatgaatccaggaagcgggagcttgcagtgagccaagatcgcaccactgcactccagcctgggcgacagagcaagattccatctaaatatatatatatatatatatgtgtgtatatatatatatatatatatgtgtgtatatatatatgtgtgtatatatatatgtgtatatatatatatacgtgtatatatatatatgtgtatatatatacgtgtatatatatatacacacacatatatatgtgtatatatatacacacatatatatacgtatatatatacacatatatatacatagatatataattttattctaaaaacctagaaaaactggataaaataaactaattcctagaaaaacacaattttcctaaatgagaaacatttgaatagaaaaccagagtagtcctcatatgtattaaagaaattggtttcactggcatattctatgaaacatttaacgtagaaataatgctaattctacataaactctctaaaactagagagaaagaaacacattccaagtaacattaagtggccaaagtaactctgatactgaaatctgacaaatatattttaagaaaatatgattacaaaccaatatttctcatgaacatgattgtaaaaattattatattagaaaattaaatcaagtaatatgttacaaaaataacatatttgtattaatagatgcattggaagaatgcatgagagtttaaattgtttaaaagtcatgcatcaatacctaattcattgagagtttttagcatgaagggctgttgaattttgttgaaggccttttctgcatctattgagataatcatgtggtttttgtcattggttctatttatatgatggattacatttattgatttgcatatgttgaaccagccttacatcccagggatgaagccaacttgattatggtggataaactttttgatatgcggctggattcggtttgccagtattttattgaggatttttgcatcaatgttcatcagggatattagtctaaaattctctttttttgttgtgtctctgccacgctttgttatcagcatgatgctggcctcataaaatgagttagggaggattccctttttttctattgattggaatagtttcagaaggaacggtaccatctcctctttgtacctctggtagaattcggcagtgaatcagtctggtcctggaattttttttggttggtaggctcttaattattgcctcaatttcagagcctgttattattggtctgttcagggattcaacttcttctttgtttagtctttgcagggtgtatgtgtccaggaatttatcaatttcttctagattttctagtttatttgtgtagaggtgtttatagtattctctaatggtagtttgtatctctgtgggatcggtggtggtatcccctttatcattttttattgtgtctatttgattcttctctcttttcttctttattagtcttgctagcggtcaatcaatcttgtggatcttttcaaaaaaacagctcccggattcattgatttttttaatggttttctgtgtctctatctccttcagttctgctttgatcttagttatttctttccttctgctagcttttgaatgtgtttgctcttgcttatctagttcttttaattgtgatgttagggtgtcaattttagatcttcctgctttctcttatgggcatttagtgctataaatttccctctacacactgctttgaatgtgtcccagagattctggaatgttgtgtctttgttctcattggtttcaaagaacatctttatttctgccttcattttgttatgtacccagtagtcattcaggagcaggttgttcagtttccatgtaattgagtggctttgagtgagtttcttaatcctgagttctagtttgattgcactgtggtctgagagacagtttgttataatttctgttcttttgcatttgctgaggagtgctttacttccaaccctgtggtcaattttagagtaagtgcagtgtggtgctgagaagaatgaatattctgttgatttggggtggagagttctggagatgtctattaggtccgcttggtgcagagctgagttcaattcctggatatccttgttaactttctgtctcgtggatatgtctaatgttgacagtggggtgttaaaatctcccattatgacaaacccacagccaatatcatactgaatggacaaaaactggaagcattccctttgaaaactggcacaagacagtgatgccctctctcaccactcctattcaacatagtgttggaggttctggccagggcaatcaggcaggagaaggaaataaagggcattcaattaggaaaagaggaagtcaaattgtccctgtttgcagatgacatgattgtatatttaaaaaaccccatcgtctcagcccaaaatctacttaagctgataagcaacttcagcaaagtctcaggatacaaaatcaatgtgcaaaaatcacaagcattcctatacactaataacagacaaacagagagccaaatcatgagtgaactcccattcacaattgcttcaaagagaataaaatacctgggaatccaacttgcaagggatgtgaaggacctcttcaaggagaactacaaaccactgctcaatgaagtaaaagaggacacaaacaaatggaagaacattccatgctctcagataggaagaatcaatatcatgaaaatggccatactgcccaaggtaatttatacattcaatgccatccccatcaagctaccaatgactttcttcacagaactggaaaaaaaaaaactactttaaagttcatatggaaccaaagaagagcccgcattgccaagacaatcctaagccaaaagaacaaagctggaggcatcacactacctgacttcacactatactacaaggctacagtaaccaaaacagcatggtactggtaccaaaacagagatatagggcaatggaacagaagagagccctcagaaataatactacacacctagaaccatctgatctttgacaaacctgacaaaaacaagcaatggggaaaggattccctatttaataaatggtgctgggaaaactggctagccatatgtagaaagctgagactggatcccttccttacaccttatgcaaaaatcaattcaagatggattaaagacctaaatgttagacctaaaaccataaaaacgctggaagaaaacctaagcaataccattcaggacacaggcatggacaaggacttcacgtctaaaacaccaaaagcaatggcaacagaagccaaaattgacaaatgggatctaattaaactaaagagcttctgcacagtaaaagaaactaccatcagagtgaacaggcaacctacagaatgggagaaaatttttgcaatctactcatctgtcaaagggctaatatccagaatctacaaagaactcaaacaaatttacaagaaaaaaacaaacaaccccatcaaaaagtgggcgaaggatatgaacagacacttctcgaaagaagacatttatgcagccaacaaacacatgaaaaaatgctcatcatcactgaccatcagagaaatgcaaatcaaaaccacgacgagataccatctcacaccagttagaatggtgatcattaaaaagtcaggaaacaacaggtgctggagaggatgtcgagaaattggaacgcttttacactgttggtgggagtgtaaactagttcaaccatcgtggaagacagtgtggcgattcctcaaggatctataactagaaataccatttgacccaaagatcctattattgggtatatacccaaaggattataaatcatgccactataaagacacaggcatgcgcttgtttattgcggcactattcatgatagcaaagacttggaatcaacccaaatgtccatcaatgatagactggattaagaaaatgtgtcacaaatatacaacatggaatactatgcagccataaaaaggatgagtttatgtcctttgtagggacatggatgtagctggaatccatcattctgagcatactcgcgcaaggacagaaaaccaaacaccgcatgttcacactcataggcgggaattgaataatgagaacacttggacaaaggatggggaacatcacacactggggcctgtcctggggtggggggagcggggagggatagcattaggagatatacctaatgtaaatgatgcattaatgggtgcagcacaccaacatggcacatgtatacatatgtagcaaacctgcatgttgtgcacatgtactctagaacttaaggtataataataataaataataaaaataataaaaagtaaaagtcatgcatatataatattaaaagaggaaaatataaatatatcattacctcaataaatttaaaaaatcatttgaaaattttatcatccattcatgatttaaataactattagcaaattacaaataaaaataaactatttcagtctaataaagggcaatgattaaaaagtacgcatgtaacattagatttcatagtgaaatattaactatgcagtctttaaggtcacgaacagggcatggatgactactctccatcttctatttaacatgttacaagtcttagtcagtataaaccacaaagtttggataaaaagaaatagaaatgcgtctatacacagagaacaagatttacttcccagaagttttatggaacctacagaacagctaataataactaatgaatagagtatttttcagaatacagtatatatgtacatatagtcaatgaatttttatatgcaacagaaacagtttggaaaataaattttaaaaatttcagtttcaacttctctttaagatacagcagttacatgtgcagatttgttacatgggaatatatgctgctgagctttggagtatggatcctgtcacccaggtagtgagcatagtaccctataggtcatttttttagccctcccaccttcctccatcctctagtaacctacagtgtttattattctcatatatatgtcaatgtgtgttcaatgtttagctcccttttgtaagtgagaacatgcagtatttggttttctgtttctgcattaattcgcttctggttatagcctccagctccatccatcttgctgcaaaggacatgatttcattcttttatatggtagcatagtattccaagtgtatatgtatcacattttctttatccaatctataattgatgggcacctggattggtttcacgtttttgttcttgtgaatagcacagtgacaaacacacgagtccatgtgtctttttggtagaccaatttattttcttgtggatatatacccagtaatgagattgctggattgtatggtagctctacttgatgttctctgagaaatatccacactgctttctacagtgactggactaattttatattctcatcaccagtaaataagtgttcccttttctccatagcctcactagcatctgttgttttctgacattttaataatagccattctaatgtgagataatatctcactgtggttttgatttgcatttctctgatgtttagtgatgctaagcattttatcttatgtctgtaggccacttgtatgctttctttggagaagtgtctgttcatgtcctttgcccattttttaacggggttattagttaaattctcaatataagacatttgtcagatggatagtttgtgaacatcttctcccattttgtaggttatctgtttatactgtttatatcttttgctgcaaagaagctctttagtttaattcacttgcgcttatctagatatttttgttttcattgcaattgcttttggagacttagccaaaaattctttgccaaggttaatgttcagaagagtactttctaggttgtcttccaggatttttatattttgaggtcttacattgaaataatttttgactcatgatttaaaagaactattagcagaggtaatttttgaatatgctgaatggtaggcatccagcttcagcctactacatatggctatccagttatcccagcatcatttattgaataaggagccctttctccattgcttgtttttgtctacctcatcgaagatcagatggttgataagttggtggctttatttctgagttttctattcttttctattgatctatatgtccgttttcattctagtaccaagctgttttggttacagctgctctgtagtacagcttgaagttcaggagtatgatgatgcctctggctttattattttgcttgggattggtttggctgcttgggcttttttttttttttttttttttggttccagaggaattttagaattttttttttctaattctgtggagaatattgtttatgatttgataggaatatcttttttaaaaagcacaagtatgaataaatttaagaaaaatgtaaattagttctactctagaaactacagaataatgcagatagaaatttttaaaaagttaggtaaatttaaaatattatcatgttcgttaattgaaagacttaatttttttcattttaattcttcccaattgattcagtccaaatgtcttgatcttaatttcatcatgtttttaaaaatagaaattggcaagcaaattctaaaattgatctggaaaaatcgaaatatttctaaaaatttataataatgttagaggatacacatttgctaattttatgatttattataaagtactgtaatgaaaatgagctattgtgataaaggtatgcacatagattactgcaacagaatagagttcagaaataaacctacacttaaatggtcaattgagcatcatttacaggggtgccaaagtaattcaatagtgaatgtaaaggcttgctgccagattgtgatgagacaactaagtatcactatggaggaaaaaatgaattttgaatcctcacatcataggtaaaattgaattcaaaattaatagacccaaatgtattttttaatggaaaagacaataaaaatgccttcatgtcttgagggttgggaacgttcttaggtcacaaatagcgtagccattaatttttttaaaaaatcaataaagaaggctttataaaaattaagatactctcttcattaaaaatggaagttaaaaaaataagacttagatgggggagaagtagcctccaaacatacatcaaactaaagaattatactcatacatatatttgttcacatatatgtattacatttatacataagtgatgaaatgattaaaaggcaatcaatcctatcttttaaaaaatataagaaggcttaaatgggaacataataattactcaaaaatcttacagattcacatcaatgaataaggagaaaaaactgatataatcttgttttgatttttttctctatacaaaatttattgttcaaacttaaaagttaaatgatagtagctgaaaattaaaattgaaaaataaatcgttgttgggttttttccccaagatggtggaatagaggctttgccagcatgacttatttacctgtaaatagtaaaacagtatatagagattcacattacgaacttttatccatgaaggaacatggggtcacaacataaaagttaaaaaaccattgaatgcttttaaaaataaggcagaaaacagctcacatggcatgtacagcagaagattgagagtaaattctcaatgcataagaaggaaaaagaatgcctttgcaatgcacattcccactgggaagctgggcaactcaggccacaggggaactccttgaccctgctaagccctcggtctgacctggggagcaatcaggagactgtgaggaggattgatactaggaagtgccctgcatgcattcccagacccacatgccaatagaagaccattctttatcctttaattcataggtgactgcacaggaagctgccagcaagcacaggctggagtcactggtttggagactaactggatgggaatttgtgatgtagtctcaagctggggagaagccttcataactagaactgagaggtaaacgtagcataagctccagcgatggacatgggagttggatgtccccacttttgtgagactggatcaggagaagtttagcctgagaactgcagttttgactcaggcagcaaattttttggcctggtgcagtttcacggtctgaagacaaactgcttgtgacttggctaactggtcattcttgctgccagtgtcaggctgtgggagagagccccactgggtcaggagcaggagagtaaagcaggctacactaccacctgctagtctctggagcctgagcttcccctctttccccatgctgcatctttggttcatcagtagttgctgtgctcttctatggaacattattctaggggcctgagaactgccttccaaccacttggaaggctgccacttgtccccactattggccatctcagccccatccaacccaccctagaggcagagcataggactgggaccactgagagttccagggcctaaaccatagcctgggacactcaggtacttctcatggctaacaaagggcaagcataagccctattgccaccaatgcagctgactcccacctgaaagcacaaccttcttgcctggaggtcaacttgcacagctcattacaacatctgctgataccaattcataacatttgcaaaggagacaccctttgcgtgatcttctgctaccttcattgcccattgcaccccagctactgagaaggccttcagctcactcatcctcccagtacattgctattacaactggcatttgaggaagccaccacactaaggctaattataaccaaggaaatcatacagagtatacaccactgaatgcatccagaagaaatgccaaataatcatactttttttcttttaactttttttttttttttgagaaggagtctagctctgtcacccaggctggagtgcagtggcatgatcttagctcactgcaacctccttctcccgggttcaagtgattctcctgcatcagcctcacaagtagctgggtttacaggcatgcaccaccatgcccggctaatttttgtatttttagtagagatggggtttcactatgttggccatgctggtcttgaactcctgacctcatacttaatatatatcatagacacagcctcacataaaaaagtgccatcccaatgaaaagtaaatacaaaagtaagaagtgactcttcccacatatgcaaataaatcaatgtcataatactggaagtattttttttaaaggtactattacacctctaaggaacacagttttctgtagcaatggataccaaacaaaaagaaatattcaaaatgccagataaaaaattcaaaatgctgatttaaaagatattcaaaaagatacaagataaatctgaaaacccatacaaagaaatcagaaaatcaattcaggatatgaatgagaaatgtaccaaagagatagatatcttttaaaaagataaacaaaacttctggaaataaaaaatttgttgaaagaattacaaaatacatttgaaagcttcaacagtagaatagaccgagcacaagaaagaatctcagaatgtgaaaacaagtcttttgactttatccaatgagacaaaatgaagaaaaaagaattttaaagaataaacaaagcctttgagaagtatggaactacatgaaatgaagtaaatatatgaatcatatgtattccagagggagaagaaatgaaacatctggaaaatctatttaagaaaaagctttcttagtctagcatgagatttagacatccagatacaagagtcccccaaaattccagcaaagtatattgcaagaaggacctcaccatgacatgtagccattagactctctaaagtcaatatgttggaaaaaaatttctaaaaccagaaagagaaaagcgtctcattgcctacaaaagaaaccccatcagactaacagcagactcttcagcagaagccatactggccagaaataattatattttcaaagtgcttaaagaaaaaaactgtcaactatatattctgccagaataaccttcatgaaaaaaagaagaaataatgtgttgggcgacaagcaaatgctaaggaaatttgtcaccatgagactggtcctacaagaaatgcccaaaggtgttttaaatatagaaataaaaagttgataccagccatcataaaaacacaaaattataaaacttacaagttatataaagcaattacacaaaggaggaagataaatggcaacatgagaaaatgctatcaaaccacagacaaacagaggaaaaagagaaacagactcaacaaagcaactaaataatgcttaacattacaacaggaacaaatcctgtcagaactaaccttgaatataactggatttaatgctccacttaaaaatatagttcggcagtgtggatttaaaaaaaacatgaatcaactacatgctgcttacaagaaactcagcttattggtaacagtatttataaattgaaggtagagcagtagaaaaagagattccacacaaatgaaaactaaaagaagctatacttatatcagataaaacagacttaaaatcaaaaacagtaaaaaaagacaaaaaggtcattatataatgataaagggatcaatataacaacccaaaatacatatgcaccccaaactggagaacccacattcgtaaaacaaatattattagacctaaggaaagggagagacagcaatgcaatcatattgggtgacttcaataccccactcatagcactggacatgtcattgagatagaaaatcagcaaagaatcacttaacactttaacaggactttagaccaaataaacctaacagacatttacagaacattctactttacaaaagcagaatatgcattgtcctcagtgcatggaatattctccaagagaggccatatgttaattaacaaaaccagtctcaataaattgcaggccagacacggtggctcatgcctgtaatcccagcactttgggtggctgaggcaggtggatcatgaggtcaagagattgagaccaacctggctaacactgtgaaaccccatctctactaaaaatataaaaattagctaggcatggtggcacgcacctgtagtcccagctactcaggcggctgaggcaggataatcacttgaacctgggaggctgaggttgcagtgagctgagattgtaccactgcactccagcctgatgacagaacaagactccgtctcaaaacaaacaaacaaaaaaaagcaaaaaaaatcaaaattagattaaataacttcttgaaatacagcagtataaaactagaaatcacttccaagagaaactcttgaaactataaaaatacatggaaattaaacaacatactactgttgttgtgtcaacaacacaattaagaagcaaaattttaaacattttgaaacaattgaaaatggaaataaaacgtaccaaaacctttgggatatagcaaaagcagtgctaagagagaagtttattgcattaaatacctacatgaaagaaatagattataaattaacaacctgccattacctcaatgaactaaaaaaataggaacaaataaaatccaaaactactagaagaagagaataaccaagatcaaaacagaactaaaggaaattgagaataaaatataagggctcaacaaaataaaaaattggttgttaaaaataaacaaaattaaaagaccatcagttggactaaccaagaaaagaagagggaagatttaacaacaaaagcaaaaatggacaagtgggatctaattaaatttaagggcttctacacagcagcagaaattataaatggagtaaatagacaacctatggaatgggagaaaatatttggaaactatgtatctgacaaaggtctaatatggaccgtctataagaaacttaaatttacaagagaaaaacaatctcattaaaaagtaggcaaaggacatgaaccgactcttttcaaaagattataaacatgtggcaaacaagcatataaaaaaagctcaatatcaatcatcatcagagaaatgcaaatcaaaaccacattaagataccatcttacaccagtcagaatagctattattaaaaagtcacaaaataacatgctggcaaggttgccaagaaaagaacatacctatacactattggtgggagttaaaattagttcaaccattgtagaaagtggtatggtgattcctcaaagagctaaaagcagaactatgattcaacccagcagtcccattattaggtatatgcccagaggaatataaatcattctaccataaagacacatgcacgtgaatgttcactgcagctctattcacaaaagcaaagattaatcaacttaaatgcccatcaatgacagatcggataaagaaaatgtggtacatatataccatagaatattatgcagccataaaaaaagaacaagatcatgtcttttgtgggaacatgggtggagctggaggcttattatacttagcaaactaacacaggaaccgaaaaccaaataccacatgttctttcttacaagtgggaattaaatgatgataacttatgaacacaaagaaggaaacaacagtcatgggagtctacttgagggtggagcatgggagcagacagtggagcagaaaagataactattgggtactgggctgaatacctgggtgataaaataattggtacaaaaaatccccattacacaagtttatctatgtaacaaacattcatatgtacccccaaacttaaaataaaagttaattaaatgagaaatagaaaggggtctcctttacagttgataccacagaaattcaaaggatcatcagagactactgtgaacaactatatatacccacaaatcagaaaacctaaataaagtggataaatttctgggaacatacaactcccaagattcatgcaggaagaaatagaaatcctgaatagatcaataacaagtaatgacactgaattagcaataaaaaatctcccaaccaaaaattcccaagactggtcaaattcacagatgaattctatcaaatctacaaagaaaaactggtaccaagcctccagaaactcttcaagaaattcgaagagaagggaatcctccataacccattttacaaacccagtattttgatgtcaaggccggaaagggacacaacactaacaaacaaaagtaaactacatacccatatctctgatagatatagatgcaaaaatcccccatatctctgataaatataggtgtaaaaatccccaccaaaaaactagtaaattgaatccaacagcacatcaaaaagataatataccataatcaagtgggttttattccagggaaccaaggatgggtcaatatacacaaatcaataaatgtgattccccacataaacggaattaaaatttaaaaccatataatcatctaaatagatgcagaacaagcatttgatgaaatggagtatctcttcatgacacaaaccctcaacaaaccagacatcaaaataacatacctgaaaataataaaagccatataaggcaaacccacaacccacatcatactaaatgaagaaaaagttaaagaatttatcctaagaactggaacaagacaaagatgcatactttcaccatttctagtcaccatagaactagaagtcttagccagagcaatcaggcaatagaaagaaataaaaggcatccagattggaaaagaggaagtcaaattatctgttagttgacaatatattcttatacctaggaaaggctaaagactcctgcaaaagctttctagatttgatacatgactttaataatgttcccaaatgaaaatcaacaaaaatatcagtagcctttctatatacaaatgatgacaaagagatacaaataaataagtcaattatgtttatgataactaaaatattaaagtaactaggaatatatttaaccctggaggggaattatctctataaggaaaattacattacactgatgaaacaaatcatagatgattcaaacaaatgaaaaaaacatcccatgatcatggattgcaaaagttaatgttgttaacgtggccacactatccaaagcaaagtacagatttatgacattcctttcaaaatatcatcatcacgttttacagaataaaaacaattctaaaattcatatggaaccaaaacagagcccgagtaagccaatgaaattctaagcaaaaagaataaagttggagacatcatattagttgacttcaaattatactacaaggctatagtaacccaaacaacatgatcctggtgtaaacctagacctatagatcaatgaaacagaataaagaacccagaaataaagtcacgtaactatagtccattgatatttgacaaagctgatgaaaacatacactggaaaaaggataccctattcaataaatggtgctggccgaactggattgccatatgccgaataacataactggatccttatctctcattatgtacaaaaattaacttaagattaattaaagatttaaatgtaagacttgaagccataaaaatactaaaagaaaacttaaaagaaatcttggatatttgcctaggcaaagaattcaaaagcaaatgcaacaacaacaagaaaatagataaatgagacttaaactaaaataatcaacagggtcaacagacaacttgcagaatgggagaaactatttgcatactatgcaactgaatagagactaatatccagaatctaccaaaaggaaaaaaaccattataaaaagatatctgtacttgtatgtttattgcagcactattcacatgcctttggtattttaataccaaattcaaaacatgtatagaactggaggccttatcttaagcagaacaacttagaaaatcaaatactgcaggttctcacttaaattgtgaactaaagaatgtgtacatatggacataaagtgtccacaatagacactggagtctcagaagggtcagaggtgggtgagggatgagaaattacgtaataggtacaatgtaagttattcaggtaacgggtacagtaaaagcccagacttcactatacaatatatccatgtcacaaagctgctctcacagcccttaaatttattcaaataaaaaataaattgaaaaaaataaactcaaaaattaaaagagcagaagtatataataactttaaaatagtctggttttttttgaatttgctttgcaatttacaataattattttgagaatggagtgcatattatgtgttaactattaaaataaaatgcagtaaattttacccttgtgctattagtcataaaatgcctttttttttctcattggttttcaataacaaaaaacctcatttgattcaacttcacctacatatgaataaagtagccactatcttttaagggaattgggcttcaaacacaactggacaatttttacatattttaaaagaaaagcgtgtctatgaaagaaacacttctctagaatgaacatttttacaaatacaaaaaaagaagtttcacaccctttctacaaagatgaaatagagaacagagcctaccagtatcaatcatacagcctcagttttctaagttaaaagacaagaatgtatttattcaaaatgctcaatgtaggaccaagacaaagaagacatgcacacatgcacaaacacatataactatgtaaaataaaatttaaaactgtataatatagacattaaaattaatgcttttatatatctatatgttacataaattgacaaatttatgtactttatgtaatcaattcagaacatcgtcaagatcagattcagatatgtgagatatttaaacagatctgaaaaaatgtaccacctcaaataacatctgttaataagttctcctgtgtaataactgctttcaaagtcctttctgttgatctctgggttcattcaagtttatactatcaagtgccataaaaagaatacaagatcagaaagggtatccattactcatttgtttatttagcaaacttttatggaacacttaatgctatactctgtactatgcactgtgaatacagacataaatatttaaaaccataagtttaagcatttcaatacagaaataactaaagtttaactaattctaagggaaataagtgttttggagtgtaacaaattcttaatggctaaaagcaatgctttgcaagtcacaaaagaaaaatttttactgatagataaaatggggagaatagaaaacattgtattacctgttaatgtgacagacattgttaaataacaatgtgattaaacaatttttttcacactctcaagaactgtgaagcttcagaaattttgctgtaatcacaagctaagagtaaactcataagcatttcaaggttttatggagattggcagaagaaaaaagacaaggtaagagaaaaaggacctgattaactctattactcacggcagagcaggtagcatgaggttcataatattgtgtttattccccttgtctaattgatggtgatacatataaacatagctaaatgttatcttattaatatccttgttgtattgaaatatagtgcccaaataattatctgcaatgctaattttttatgtatgtatactggaggtttcttaaatatatacatacacatacaaacacacacacagacacacacacacacacacacacacacacatatatatatatatatatattttttttttttttttttgagatggagccttgctctgtcacccaggctggagtagtgcagtggcgcgatctcagctcactgaaatctccacctcccgggttcaagtgattcttctgcctcagcctcccgattagctgggactacaggtgtgcaccaccatgccaggctaatttcccaggacaatgtggagtaatccaagtggatgactctttggttcattacaacattcatgaagagggaattttcagtgtcaaagttcattgaacattgatgcatttaaatatataatctcaccacgcaaactgtggtaattgttattacaagaacaaaaatgacaaattgtgaaacaaaagcaacaatcaaaatagtaacatattttaagtatgtatatgtggataactattctaccaaaattcaaaacaaaatcaattagttggcagttagaagggagaggtgaaaataacgagggcattattattttatctttctcagagctgaatacaaaatatgcacattggtgcatatttatttgaagaccaatttttcaatgtggttccatatgtctcacaatgtatttaattgactaaacagttctacatctaataataaatcctacagaaataattgcatacccttatatgaaagagatttaaaaaaaacttcagtgaaaaatatttcgcaataacaaaattctggactcgcatgaaattctaaacaagaatttggacaattgagttaaatgtgtttgcactaatggaacatgtaaaaaatatatcaggaaaaattttagatgtattcatattataattccacttatatctgtactttgtttaattttaatgagtattctaatataaatgtaatactatatatttatatgtatgtactatatataaatatatatacatatataaaataattgctacatttatctttcttatacagcaataaaattgtatctagttgcagggttcatgagtggcaatctaaattatatttctataatataatctatattataatataattataatataatacttataattatattataattataatataatacttataataatattataattataatacttataataatattataattataatacttataatactctcattgaaagtagatttgggaaggtgatgacattgtcccatggaatatgacttcacatctgaggctagcaagtgaaatatcggttatgactcacctgcaatttcctcctcctggattttggagctatgtttcatgaaaataaagcaaagcttggagggaagggaagaacaatgattgaatgacttcacgagttacagctgttccacaaacctgggcaggtcttacgaccatcaaatattgaaaagacagaaaaacatctaactgtaatgccataaaaccatctatcacaaatccacagccaaaatagtactgaacggggaaaagttaatagcattcccgttgaaaactggaacaagacaaggatgcccactctcaccacttctattcaacatagtactggaagtcctagccagagcaatcagaaaagataaaaaaaaataataaagggtggtaaagaggaagtcaaactgttgctgtttgctgatgatatgatcaaacgtttacctagaataccgtaaggatgcctccaaatagctcctaaaactgataaataaattcaacaaagtttcaggataaaagattaatgtacacaaatctgcagctctgctatacaccaacagcgaccaagctgagaatcaaattaagaactcaaccccttttacaatagctgccaaaaaatataataaaatgcttaggaatttacctaaccaatgaagtgaaaaatgtctgcaagggaaactacaaaatactgctgaaggaaatcatagataaacaaacagagacacatcccattctcatggatgggcagaatcaatattgtgaaaatgaccatactgccaaaagcaatctacaaaatcaatgcaatgcccatcaaaataccaccatcattctttacagaactaggaaaaaaatcctaaaattcatatggaaccaaaaaaaagcatgcatagccaaagcaagactaagcaaaaagcacaaatctgtaaccaatagcaaagacttggaaccaacccaaatgtccaacaatgatagactgggttaagaaaatgtggcacatatacaccatggaatactatgcagccataaaaaatgatgagttcatgtcctttgtagggacatggatgaaattggaaatcgtcattctcagtaaactatcgcaagaacaaaaaaccaaacaccgcatattctcactcataggtgggaattgaacaatgagatcacatggacgcaggaaggggaacatcacactctggggactgttgtggggtgggagggaggggggaggggggagggatagcattgggagatatacctaatgctagatgacgagttagagggtgcagcgcaccagcatggcacatgtatacatatgtaagtaacctgcacaatgtgcacatgtaccctaaaactttaagtataataattaaaaataactaactaaataaaaattattcaaaaaaaaaaaagcacaaatctggaggcatcacattaccttacctcaaactatactaaaaggccatagtcaccaaaacggcatgatactggcacaaaaataagcacatagatcaatggaacagaatagagaacccagaaataaagccaaatacttacagccaactaatcttcaacaaagcaaacaaaaacattaagtggggaaagggcacactattcaacgaatggtgatgggataattggcaagccacacgtagatgcgtgaaactggatcctcatctctcaccttatacaaaaataaactcaagataaaggactttaagatctaacattataaaaattctagaagatgacatcagaaaaacctttctagacattggcttagtcaaagacttcatgaccaagtacccaaaagcaaatgcaactaaaacaaagataaatatatgggacttaattaaactaaaaaactctgcactgcaaaagaaataatcagtagactaaatagacaactcacagaatgggagaaaatcttcacaatctatacatctgacaaaggactaatattcagactctacaagcaactcaaacaaatcagcaagaaaaaaaacaaacaattccatcaaacagtgggctaaggacacgaatagacaattctctaaagaagatatacaaatggccaacaaacatataaaataacattcattatcactaatgatcaggaaaatgcaaatcaaaaccacaatacaataccatcttactcctgcaagaatggccaaaataaaaaaaatcaaaaaataatacatcttggtggggatgtggtaaaaaggcaacacttttacaccactggtgggaatgtagactagtaaaaccactgtggaaaacaatgtggaaattccttaaagaactaaaagtagaactaccatttgattcagcaaccccactgctgggtatttatctggaggaaaagatacaaaaaagatacttgcacacacgtttatagtagcaaaattcgcaattggaaaaatatggaatcagaccaaatgcccattaatcaatcagtggacaaagaaattgtgagatatatatgcatacacacacacacacacacacacacatatatatatgtgtcatggaatacaactcagccatgaaaagggaggaaataatggcattttcagcaatctgaatagaattgaagaccattattttaagtgaagtaactcaggaatggaaaaccaaacattgtatcttttcactcataagtgggagctaagctctgaggatgcaaaggtataagaataatacaatggactttgggaacttgggggaaagggaggcaatagggtgagggataaaagactacatattgggggccaggcatggtggctcacgcctgtaatcccagcactttgggagaccgaggtgggcgggtcacgaggtcaggagatcaagaccatcctggctaacacagtgaaaccctgtctctactaagaatacaaaaaattagccgggcgtggtggcgggcgcctgtagtcccagctactccggaggctgaggcaggagaatggcgtgaacccgggaggccttgcagtgagtggagatcacgccactgcactccagccggggcgacagagtgagactcgtatcaaaaaaaaaaaaaaaaaaaagactacacattgggtacagtgtacactgcttgggtgatggatgcagaagaatctcagaaatcaccacttatttatgtaaccaaatcccactggttacacaaaacctattgaaatcaaaaaagaaaactaactctacattatgtaggtcaaataattatgaggtcttgttaaagcagcttagctttccttaaaaagaaaaaaaacatgaagttgaatcacctatttttaaaaaagtatgaaagggactatgaagtgatacagaatataaatcacagtgaggatttgcatgggttttaatgcataaaattatataaaatagaaatatacagcacaaaaaaaaacccggataaacatgggggagcccacacaaacacaaatgaagacataccctttaataaactatttagtcttcagcagattaagtaaacaagtgtaagtataagatgtgagtaacacgtatgcaggcctgaaaaaatgagtactgtcataacttgttgacccaacaattcttctagcttaaataattggttggtttaaaaaattaatcaggcatgtgtgcaaaaatgtacctgcatttagcagtactgcgtatgacagggaaacccttaagacactttatatccaaagcaacctattctgatattcagcttattttaataaagcaaaatgcttgtttacctctcttattaaataattcagacccaaatctttttgctttcagttccaaatttaatccttttactcccaattccaaattcctggggaaggaagtctgatctacccaggtttgataaaactacctcattttgttgggatacaattgtccatgggtctctcatgtttctgcatgtcatgtgcccagagtcaatattctggacaatcttcacaaggatgtttgtcttccttcagcgtaaatgacagatttgttagctatttgggaaaaaaaaagtctccctcaagggcaaaggctgggcaagtttgctagtatatctcctataaaagattaggattacctaaacttggattttccagctgtgatgcaaactcactacatgtatagcatctacaaggactgtctgcattgtcctggaaacaaggagaactaaaacaaatgtgaagttgtgatgcctgctgtgccatgaaaaatcaagtccattgtttctgactcaagtatcccttagatcctaccagaatttatgaaactttagcaatctaacatgcaagtttacaaaaagcagaaaatagcagaccattcccagtttttgacatcgtgtttaatttgaatattgtattaatgcatagggcaaagatgattgcctggcatacatgcacacatacacacacacacacacacagcagtaagtaatgtactaaattatctatgtgcaatggaaaatacagatgaaaatataatatgtttttaaaaagtctggaaaaatgatgaccaaatgggtacagtaattatctttgagtgttagaattttctttgtttcctattttgtcttttcaaataagcatgtatatttttataacttataccatctcatttgaaaatgtgaaatccttacaattgtgatacatcattaaagtgatattagtcatcacaatgttgtcagtaatcaaacactgcatagggcatttcttccaaatcactatcctaagcttaaaaataacatttgatggagttcatttcttcagcatttttctatatccagttagatgacattacaccttctttatataaatattttttctctctttatattcttttgtacatctatacatttgctcatattttaaatattttaattatttatattcaataggctaccaaattgttttaaataataactttgctgctaagtatacccctgttaggaaagtcagaatattatttaccataatcacttctaggtgttcttgaagcaatgaaggcaataacaaaaatattggctgtaaattgtatagtccattaaaattcaagataagaagtcagattgtatgaaggagctagatgccacatatgaaaattcgtcctagaggagtagtatgtggtaacacattgttctcattacaatgtaagctatgcattaatatgatggaccatttattttaactttgtggcatgaaaattaataaatcatgagcaactgcaaactggtgattttttctttaggcatattttcaaaatatttttaacctggtttttttctggtgctcttcagctaagtcttggaatctactgtgtgacttatgatcaaattgtgttttttacttgatatatacagaaattgtccctcaaattaattttccaaaatatgaagaatatgaaaactttactttgcaggaaatatacttctaaaaataagtatttccttttagaaaagagggggaaaccaagaaaatattttaataaacacgtcttataaatagggacatgattattaatgattaaattctcattgtataaatgacaatttgtagatacagaattaagtaatttgtctaaggttagacaggtaagaattaatagggtcacaataaaatccatgtcttctcattatgtagatggttttccacatggcatttcatagctggtattgtcatgttcatagtaaccctgtatccactcttaaaatgttacaacccttcctcttctaccacatctcaggtggaaaaggagagtgccaagcatgggccatcccttcacctgcatagggcaccaattcacctcagcctttcattagccacggaccaaatccttcatccagttaaagggtagccaatagggacctcacaaggagtacagaaaaccaagaaacctggaattgggcccttgagccgcttgctctggcccactcccaccctgtggagtgctttctcactttaataaatttctggtttagctgcttccttcctgtgtttccttcctttgttactttgtgcagttttgttcaattctttgtccacaacatcaaggacctggacaactcatagtcaccaccttgcttcctgtaacaaaaagacactgcgtaaccttaaatagaagctcacttgctcaaagagtgctctccagaatatgattggggcagattgccatttacttcatgttgccatgttttcttgtggaacatttatgcaaatgctcacaggaggttggagatagtttgaattatggtcaggacaacttattttatagttcaaaagcagcagcctggtcttcactttatgaaatgatatatgatataggtgctgccacctcgaataaacctgaaagttacacagggattctgtggacagaaaaagagtattgccttgaaagaaaaatgccgtaccgtaagacagagctacggagatttttgcagaaaatacaattttctgacaaggttgtctcatcttgacaagacatgaattaggtgttaatactgtaattaggcgtctcattactaataattaaaaagacattgtttacctcaaaaattgattgcaccaatatttgatttacaagaaaataaaggctttaagacaactgcttcaagcagaaagcaacattgtattttaaaagttaaacctagaaatgcttgtttttagaaaatagaaaatatatctttgtattaagacagttgacactttcattgtgttttaaactccctgttttatacatgtggcttatatatgtgtgcccacaatagtgtgtacagggttgaattttgttactaactttctttaataagaggaaaaaaacactaagaattgcaattcaatagtttatgtattacatgcatatcaagatgaaaatctattaaaattggtcaaattactctgctatgaccatgaccattaaccaagaaacactgggtttggcctagtcttaggcatcaccggaaaatgtaaagaatataatgaatcggctcattcttactctgtccagtttaattctacagaaacaaggtaatacaaaatattcatccaagagtataaaatttaatgagaaagattttcagatacacagatatgatgcaatataaatattctaagtatgctattctaaatacgctatgctattcctcagaaccttttcagacttgcgcccctccgaagtcaggttgtctcttccccgaagtcaggccatctcctcctctaccaaatgagactccggtctttataggcacaggatggggagtgcattctgactggtttgtgaatatgcaaaaatggttaaagcaaagacaccactcaaagttgggcacaacagtgtggagaaacaattaggaaagggtaggtatatgtaaaataggtgaagggtggggattgataagaggaaagtgcaccgaacccagaggacaagttctcaatctggtccaaggatttaactcgtaacttggctttcaggctttaaggtgccttcagcttggagatggggtttcactaggtacctgtccctatctgcctaggcatttggctgcctcctgctactatcaattccataacagaaaaagacatgtagcaatgtgtgtgtgaaataaaatagtgtgtgaatgtgagtctaagaaatatccttaacattctcagctatagaatatatacgagctgtagcatatgaggcacaaaaggtaggtggagtatacttcataaagtgtcttagttaaagagataagagtgtttgtggaagcatgattaatctacttcagaaagatagctttagcaccagtgtgaaaatgatttgattgtgaggatcctggtgatgttaaaggacgaggaagctggaggaaggaagttgggggattatggaaactttatgttcagcaacgaattaggatcctgcacaagcaaggaatgttaaaggccagaattaagacaatagtgaaacaacaacagaggaattaatgttctggaagcagtgaatgatcccagtggaatttctgaatattgtgtatatttgtcagaatgtagcaccaactatgcaaatgttcttgcaccaaaaacttgcaaaccacaaaggcaaccccttaattactaatgccagttagtgccactgcagtaatttcctgagtaagcaatgagttcatttctctggcaagttatctcaaagcatggaaaggctgaggcatttcaggacccacgccctgcaaaagaaactgaaatgctctaaggtaaaacagaagacaactatgcaacaagagagccaaattctcaaaggcaatggagtgtagcacagtttgcatccaaagatcaaattcataaagccacacatcaaaacaactattagaagaatgcattctaaaatcatccgcaacaccactgacacagtcaaaatattcataaaccaaacaaaacaatgttcaagcacccacaggtccctatcaatcttttgaagtgcaaaacagccaaggaaaatgcatttttaagataagtgcacctaatatgactttgtaaagtaactttatgtcctaaaatgccagtgttataggtaataaatataaaatcaaggcaataaatattccttcaaacatgcagcagcattgagcagcattcccttttggtttccagaatatgatttccaaaactgcagcagggaaaatacttactttgaacctcctgcctctccaaatccaacataagctggtctggattggaacaattgtcacctatagtctcagcatggaatgtgactgttttcaagattcctttcatgatgctgtcagcgtgaaaacactcaattgtgtcctcagcttgatctttaaatgtcatttttaaaacagatttgaagtaaaagaataccattctctccatttgttcaaaaggagatatttccttcataagtttataaaagtctaggtgttaatgaattactcacctaatatagactccttaaggcatcagcagcagcttgcatcaggcgccctagggagtataggggacttagaaataaagaactatttacctataaatcttgtgcacatgttttcagaagggcaagacttgttcttggtttcaggtaaggtcaacaagcttaaaaaatgacaattcttggaatttctcagtgactctatgagacctatgtaacagccacttaatatatatgttaaataatgttttctgtgaaatttctttatatattaagaagggctttcctgtatttcttattccactggattcctggaaggggactatcccactttggcaaagctccatgaaacgaataaccttgggaaaatgtgcataaaaatgtattactgaaggcattatgttccaatatatgagcctttagtttctttgcttttcaggggctcacaaagctatatattttcagagaactaattgtgttcatttattgcaaattttataatagcaagctaaatatgttggtattttagaagatgaatttgaagaagtaaattgtagagatctttgagaggcaatgtggtctgcattacaatgatggtggtaaaataaatggaaagacttggaaagattcaagaaatgtttgatagacaatgacaagtaaattattgcatgtagtggatgagggagtacacaaagaaaacctcattgttttgggcttgagtaactgggtgattatattaataaccatgagaaaaaaagataaaatctagtacgggaagtattctaataagtgtcttttcccagataaggaataattgagaggaaaactttcctttttgactcagtcatggctttagcagaaggcaatatgacataatagatttcactgtcaacagacaagtttttaaaattttcatctagcagttgactcgtgtgtaatattagtaaagccatttgacttatttgaaacacattttctttctttctttttttttttttttttttttttttttgagacggagtctggctctgtcgcccaggctggagtgcagtggcgcaatctcggctcactgcaagctccgcctcccgggttcacaccactctcctgcctcagcctctggagtagctgggactataggagcctgccaccacgcccagctaattttttgtattttttagtagagacggggtttcaccttgttagccaggatggtctcaatctcctgacctcgtgatccgcctgcctcggcctcccaaagtgctgggattacaggcgtgagccaccatgcccggcctaaaacacattttcatgatctctaaaataaataggctgatgagaccaccccctctaccagttgctaggagaacaaaattagatcgtgtataaagtgccgcttgaaaatgtctatctagtctcaaactctcctgcctttttctagatgtgttaatatgtaggtgaccaaagcaaattgtattaatagtttaaagcagcagtccccagttttttttttttggcaccagggaccagatctgtggaagattatttatccatggactgggggtgagatatggtttttgggatgattcaagtgcattatatttatcatgtactttatttctattacaattacattgtaatatttaatgaaataattatagaactcactataatgtagaatcagtgggagccttgagtttgttttcctgcaactaaatggttccttctgggggtgatgggagacagtggtacctgaagtgtgttgcttacgtccagtctactccaaaattgcttttcagttgttgtcactgcagaaaaccgtgcttcacaaagatagcatgatggaaatggaagcaggcttctcagtgcttttgtggcaatctcaggatattctgccttgactttaatctgaaatgtatggagatttgaagttgtctcaaacatacttttaaggccaccatcatttgtgatctcaagagggtgatcctcttctagcacagacaaagttgattaacctggcttattcacaaatgggctgcagatccattccttccaagtttgggggttttctgtggctgggaagtaatgctcagatgcttgaaagctgagataggtgatgatgtaccaactgggagaaagaagaccctggctcagtctctttcaaaatctctgctaatgtttgaaacatgtcaaaaatcccaatgctcactcattgccctcataattcccatttggctttgaatgcctccactttatctgctgactggaacagttatcatttgcccctgacgtcacagcttgaattcgttgagcaggttgaatacgtcacacaagtaagcaagttttgtcacccattctgtgccactgagttgtgcttccagtggtgactgtttttctaaaagaaatctctggagtggctcttataactccaaacctctggccagtgatctacctttagaaagtcacctaacttctgcagataaaagaagaaacaagtgctctgcctccatctcctcacagagctgcatgaagagacgtgtgagttaagggtgtatagtttagtgtggttgataattttaatcacaccctgcaaaaggttaagttcaggtgacatttttgagttagccagcatttctctatggatgacacagtgtgtaaactcacattcagaagcaatctctttgatccaaatagtgaaaccagaaagcagtcaagtcatggtagccgctccatccatccatatattcagcacaaaaaccaattcagttttcctggcacgtaatcattcaaagacttggatagttttgcaattgcgatattggttggcaacaaaagcacacataacatgtgttcatgcacctcctgaaaaatatgttgcataaaaacaagcattgttgccttgttatcaacattggtacactcctcaacctggattgcataccatggtgattcattaatcctctctaacaattgtgccttaatatcctctgccatttcaccaatttgtctacttatggttctagctgaaagaggaagacgttgccaccttttgaactgcagcctctctgagaagttcatgacaaatgtccttagcaacaggcaggatcaactcttcaccaatagtgaagagcttcttggctttagcaatgcagttagcaactaagaatgatgcgctcagtgcagacacatttgatgaagtggtagtcttcagtaattgcttctgttctttacgttgatatttttttttcttttgaaaaactccaaaggcttgtattttaatgcaggttgcttggtctccaactggggaagcagttttgaaggtttcatgcctttgttggatagctggttgccacatattatacaaagtgggcttggagaaagtgaatcgcctgtagcaatgaactcatgatttaagtaggactcttggtattttattttaaatgcagatttttgttggcagtcttagagtcttctgctgtctcatcattggctcttcccccttttcaaagttttccagtaatgtttgattttaactcattttggctagggttagcttgtgggtttaccaaaaccgtgactgagacaagtgcatagtgtgagaaaaaggtatagatggaagtggtaaataaaataatgagtggaccacatgtggactaaaataagtgtcagattctgacttaaatcctgccaccagatgtagcttgtcgcttgccagtcactaatagggatttgatatgagtctgcaagcaattgacgtattatggtctctgttcagtgaaacctgtctgctaatgttaatctttatttgcagctgctccccattgctcatatcaccacctcagctccaccttagatcatcaggcattaggttatcataaggagcttgcagcttaggtccctcacacacacagttcacaatagagtttgggctcctatcagaatttaatcctgctactgatctgacagaaggcaaagctcagggcggtaatgtgagtgatagggagtagctgtacatacagatgaagctttgcttgctcactgatcacctcctgctgtgcagcctagttcctaacaggccacgaactggtacctaagaggccatgaactggcacccctagtttaaggaatatagagtttttcctgcttacttcaaaaagagtgtatcaaaccaaagtccataccctttgaaactatgctatgaggcttttctcaaaattccatcatgtaatgtagaggtatatgggtctttacacttaggttcaaagttgatggaggccagaaattgtggtagaatgcttatttattgggccacactatgagagtcactacctcaaaagcctttagaaagattatgatacatattaaaatttctcagtatagaaattcctcaaaattctctttttcacattttctttgatgaatgcagagaggaaagagagacagagtgtatgtttgtgtgtgtaaaataagctcagacattatgaaatgaccctgctctgagctgttctgcctcttactacagttagttctgctataacaattgttttgaaaacacaaatttattctagtgtaatggatatattagggtacaatttaagcatggtgtgaatttcctgtttacttatgcatgaattcatccccgaggaacactaggtgaatgcataaaaccacttagctgaactgagctaggtaggaatccacaacagtgcaagcacaaacacccctcaagtatctaccagccgccttagctgatgacatgggttatgagccactcccatccacccctgtagttacagctttccacctgatttcaaataaccctcctttcaccacttcacaattacttgcaggctgaaaccttccaataacctctccctaaagcaaacttcacatctttctcaaggtaaaatacatatttcatgtatttttttacatatttatcaattccttaatgtatatgcaatgcacttttgaccttatcagtttatcattttttcaaatgtgtcccttatgaagttgttgaatgttatacacttcacctcatctccaccttaacattcacgcttttcattgtgtgattttgcatagcacagtacattttaggaatacatatgcctcacagcataattgactgtatctaacaacttgttcaggtaacatgatcctcttcagtactccctgtaaaaggttaaaaatagtagaatcaatctcagagctgttgacaaaattaaaatacgtgtggcgcatttagtatatgccatgcaatatcatagtacttaatacatgttagatattgtgataagcagtatgatagctccctgaaggtatccacacactaatctctggaacttgtgaatattttgtgttacacggaaaagtggactttgccaatgtaattaagactttggatattcaaataaagagtatcctggatgacccaggtaggcccagtctaaatacgtgaacccttaaaggcagacgattttcttaggatgaagtcagaaagatgcagcagaggaaaattcagtgagatttgaaattcttgacaagccattgctgatttgaagatgaaggcgggcaagtgatgtgggaatgtaggagtctttacggacaggctccaggataacagtcagcaaggaaaaggaaattagatttttcccttaacctcaatgaggttagaaccagattcttcctagctagctgacaccttgatttgggcctttcccaacctgaaatggagaagcaaaacaagtccatccatacttctgacctacggagttctgggatatgttttaaactgtgaacttttgggtaatttattatgggaacaatagaaaatgtaagttttattgctattaaatatttctatttttattaagggaagagtacattgctattgggaaaaatatcattttaaactaaaaatgttatattttaagtttttaagttaacaagtcagtcatcagttactaccttaagagcagcatgaaaggaacaaaagaaaaattcctgagagagaaaccttggcaagaaggagagatgttgcaggcaaactccatttgcctcacaaatgtgttttgggccagtctttctttatatgtcgctaaactttgttaaatatttgtatatacttcgggaggctgaggcaggtgaatcactggaagtcaggagttctccaccagcctggccaacgtgggaaaaccccgtctctactaaaaatacaaaaattagccaggcatggtgcgcatgcctatagtcccagaacgggaggctgaggcaagagaatttcttgaacctgggaggtggaggctgcagtgagccgagattgcaccacagcactccaacctgggtgacagagtgagactccatctcgaaaataaataaatagtatgtcaactccaagtcttgccgttagaaagaccataaaaggtttaaacctatatgttagtgtcctattactgctgtaacaaattactaaaacactagtgtcttgaaacaatacaaatgtattgtctcccagttctggaggtctgaagttgaaaatgggtctcactggtataaagtcaatgtatcagagggcatagggctactactggaggcactaagatagaatctacttcctcaccttttccagcttctacaggctgccagcagctgttagcttatagctccttcctccctcttcaaagccagcagtgcagcatcttcacatccttctctaacctctgcttccttcatcacatctccttctctcaccttttccttcctgcatccttcttatgagggtccttatgattacatcagttctacccagattatccaggacaatctccccatctcaatatccttaacttaatccttaagtaaatttccctgtgccctgtaaagtagaatattcacaggttcttggtattaggatttagacattttgggagggccatcattctgcttcccacagccagaaacaaatatatttctaatggaacacatgatttcttaaataattataacagttccattccagctatttctcttaaatcatatattcttgcagttttccatcccctagagtctctttttgcttcaggacatgagtagatagaacctcattaatgagacaataggctggaagaaaggttccaggtgaagactatactagtgagggggaaaaaacaaaaatactgtgtttttggactcctccaatattattccagttgttctacaaacaacacacacacataccagtctatctttctctttatcaatctatccatccatataactacctatctatttagacatttatttttcaaaatgatttatggtgcctcttttggtgtttaattttctaaatgtgcaaacatctgcatttttttatgaaagcctaaaatatgcatcataagcatgccatattattaagcatgttttgagatctaaaaccagttagtgctctgtaaactgaaaataagtaataaggtgtttttatattctctaagccaaatattccaacttacacttttattctacaactaattatcaagtgtctacaaagtgccaggctctattctgggcctggggatttagtaggaccagaaacaagaacaacaggaacaacaaaggctaacacaaatatctgtctttatggagctcacaattcaataagatagctgagcagtaagtaaataaataataaaacaaggacagtataatatgtcacttaatgatagtgctacaggagagtgaaaaaaggcaggaaagtggggctaggggcaggaaggttccaaaggaaactgcaattttaactatggtggccagagtcagatgctttgctgagaaagtatctgagcaaataaaaaggaggtgagagataaagactcaagagtatttcaagaaaagaatctttggtggaggaagtggaaaatcctagagcaggaaatgagatttattctttgagaacattaattccatcttttaactaatatttattgatggcctcaaatgggtggggcactcttacatcagtacacaaaataaatcccctttcttcaaaaaacttatattccaaggaataacttgactttcctttaatttattctactctgtcatttttctgaaaatgagggaaaatcaattttcctgtttatgaaacaagaatagcacgataagcccaaaagagaactttagagattatttagctaaaatgtttaaagtactaagaatcatttttatagaataatgattggccagtataatcaccacattgaaatcttggttttagtttgcttattgttagtttgaattttagttccatcgcatctaggccttacatttgtagggcttcagttggaaccagatgatatttggaacaaaactgatttcatgaagatgatttcctagagtctaacacccagtaaatgcagtcagtttattcaaacattacactgtttccagagtaatgtatgttgcacaaataaaataaatcatggatttagagagaagctgaagtgttgtcaactgggctgtaaatgtttcaacataataaactgtacagtagaatagaagtagctcaaaagttgaagatttcagtttgtgatgcagggaaaaaggatctgatttaggtaggaaagaaaagagaattttaatgatggaaatggtctaaaagaaatcgtatatattacggttgtcagtgtgacagatggtgagactgtatataataaagtcaaaagatattttgacaagaaagaagatggatctgacagttcagaaatcagaatcctgggcagtaaaaaatgagaaaaatataattgaatgtgtgctcagctgatacatagttaattttacacagcccaaggcaacagagtatgggaaatggtcagtagtgttagcagacttgataaaacgaagagaagaggagggataatgtgaaaacaaagcaaaggaagacaacattctaccacctgtaaaatagtattttcagtaaattatttgaaaaaaaaaaaaaccagaaactaacccatctgaatccattcaaaatggtcatttgaacaatacagggctagatttaaatgctattatactttacataaatatacaacatcccttaaagtaaaactaatttttttcacagctacaaaggaaatacatttcattaacactgtttcttaaaataatcctagaaaacaaggtctctttttgacacaggtatttgaatttccttggccattaacatcttgtaactaccattgttttcagatataattctatttaaacaaatctaaaaagtgatagattctttagaacatgaataagttatataaaggattacccctttttctttcaaaaagtgactgtgttattcgcctgatgttatgctaggcttccgtattgttatcacagggacactctcaagtatagcttaaaaatacacttgtccttcacattcttaatacttttaggtcagtatatctgtagcagcaaccccttatgttaaaacctggaaagggtaaaacataatggcttcatactgaaggtttcagaaggggaaagaaaggccctaaggaaaaaaaaaaaagaaactggtttaagaacacacagtgagcatgggcagagtggacacatcgaggcagacattccatctgtgtagtccatgctcttaacaactttgccataatgacttatgagccttacctgtgaaacattccttgtcattatccttgtcagtcacatgtgcatttacaacaggaaaacgagacaaatacctaaatgctttcagaagaaacccaacagtaggaaaaaataccagaaatgaagaatgtctctatgttgtttttgtaaaggacagagttctcagagatattttatgtgtatagatgaaactaaaaacggcactgcaggatgctttaataatctttattgcatcatatttgtgaaaattatactacatcactgccatctgtagtgatgcataaatcacaaggcaataaagcctcctaataaatcttacgcccactctcttcacattattgatcccttttatttgctgatgcaagaactcttccatatgttgatgcagcatccgtgatctatgtgtcattatcctttatgtctaatagcattttctataaatcaatatccttcctctttgaagatggtcctgcagaatgaattgctatatgcttgtgtgagcatcgctgaaagcctggaggtgtggcatggcttgccattccctcattagtctgaggaaatttgtaggtgatcgtttgtggatcttccatgggttttgtcacagcctcaccctgttaactctatgttcctagtgagtagcctcagcagttttagcctcatcactgcactgtgcctagtggtcagcagtcttggatctgtgcttatcatcagatacagccctgttccactacttgacactctccttaaccataacctcctggtggtcccacttctatcagcctccatctgctaacacatcaatcacagaggatttgtttgagactcttaatgtctcataatgttataatcattgttgtttttttttttgttgttttaacatttaatacaaggaaactgctatagtgagaacatatttagtgctgatttgatagtaaacttgaggagctgatttaagcgattgtaggtaaagtcggttatacactagttctctaacccattcaggctgagccacttacagaaaacccaatctgcagtgttgtgttatatttcttttgcctgccagcctctcaaagcatgtgcagttttgacagtttcttttgccttgcctgctagccaagcaggtgacagaacattgctgtaaaagaaactgctttggatagctttcaacgttaaatcactaatgtagatttttaatgttaagcaaaaagtccatggtgcaaatggaagtatgtctgccttcatatttcacagactcttagcctaatatgtgtttgatatgctatcaccttaaaccactaaagccatgtgctgctcaaacatcataaaacatacaatcctatttttctataaagaatagtttacatctgaagtcagatttattttgaaatttcacatgctaacacaaagcattaatgttgagtgggaaaactatagaatctttagaaaggtatcagaataacttcaaaatgaattcagtatttttatgtattattatatacatcatctgatatgcactgaaaggatgaaaccatttaataaaggttaaaaaatagcatttgtgagtcaataatgacttcaaaattaaaacaaataggtaacattctaataatacaagtaatataccacttttaagaaaaataatttgtaaaaggtggcttcaaattttgctatagaaattatggaaagaacaacttaatctcaaaatcttttctagtatacccaaataagctgactaagaatttcaactctagaaacttaacaaaaatgaaaaaacaaatcaaacaaaaactccaaaatacaccaaaaatgtaaaagtgtatatttattagggttaataaataaagaagaaagtaaaagaagagataacacagaatgcttcttccctctaaccacccatttctggtcacagatgggaaaatcttacatttaagatcctctctaatatagatgttgcttgtaatatgtaggatattaatagttccctttggaccacgatgttcttgacaataagtccagtaagtcctacaattccttatatccaagcagaaagttattgtagtagaaatgggtaatcaaatgacatttgattcattcattcattccactcattgaggagagggtttcatgttttgagttactttcctatcgtgttctcccagcccaaccccttcccacccatcagaataggggctaatcccccaaagtatcatatcttattgacttatttactcagactcagagaagcaatgatttaaggcattatgagctcaactggtttatcttcctagagaaatgaaggactgctaaaataagagtcaaaatattcatatgccctagccctattatgaatacaatattaaatttaactcatctattcaggcaaataaaaataatcattgtcattttgacttcaaagtgtcctctgacttactcctccaagtcttatttcagaactaaacagcatcaccatccaccaagacctccagcacagaggaagcaggagtcatcattgattctacttcatcctcaacgttcattttatatccatgtcttattgatttcaccttcagtaactgtttaatcaacctcttctgtttaatcaagctttttccttcttctgtttttacatcctacaatttcctgagagctctcctcataaaacataaaattaatcatgtagctacattgctgatacatttaggtggccttctaatgcctacaaattaaacccaaaacctttatcactatgcaatgtaaacaaaagtgtttcaacatgttccatttataatgaacacttaatgttacaggttcaaaaatacccctattcttcccaagtatgttgacttgacaatatccaagacttttgtctccctcattcttttccttctttataagttgtctttcatcttcttctctgccaaacaaaattcaaccaaccctcgagggcccaattcaaatctcactcttcttttatgagccttgctctatacactctttcccccacatcacctctttttctagaaattctaattatttggatgttatgatgtgtgatgaatgtcttttaacaatttacatgcctgcatgtaaatgagattctggagggcaaagaatatctaattcatacttgaatctcaatatttcacacattgcctagcactggagtttataaatatttattgaatcaagtaaaattctctaatcttttaaatatgcaaacatgatctatgtatcttatttaaataaatatggctcatgacttagtagctaactatagatagatattataaaactatattgtttaaagttctgtcatggtatatttctaccaaaatgttcagatagaaaaagaagagattcagttggaaatgctcttgtaaagaacacttttattctatgataaatagaagaatttatccctgactaattcaaccagaaaagtctttttgtagaattcaattctataaccctattcaatggagttaatgattgtttcacatgagtgatagtaatacattaagatttatagaaggatgtgcaagaaaacatagccgaaagcagatataatatttaaaatataattcctgtagaacgaaaacaaaatctataagacagggctccatagaaacataatgttccatttcaggctttcaaaacagacttacaaatgaaacatttcataaacaatgaataacatgcacttaagaacctcacacagagaaaaattgcaactgagcatgcatgtgtaatttgcactacagtaatcttactttttagcaaatgcaaggaatcctgtcaccgaatggtgagcaaagtgatgggtggcatactgatgttactgaaattctctccagaggaatatggatacaaaaatataagtgtaatgttttgtacatataatttttaattgccaacaaatgtaaataaataatttgaagcttgttttcatcaagctatcgatacgctctttagaagaagccactcataagactgaggaattagacatattaaattcttaaagttttatcttggaggtgggacgatgctcatatttctgcattgcgtaattatgctttttttcagagatacaatttccttcagttttctcacttgcacaaagcatggaattctggtacttaaaaaatttattagacttttagtttgttttatttctttgcatacatataaaccatgggttaccagctgtttacaagtttactcatgaatctcaactctcctgcactgacctatcatcaaacggtagccatatcacctaccagttcctcagggaacacatgttattgaagctacttttttctctttaaatgtgttacaagtagtaaactatataattattttccggaaaaacaatccttgaatttcttgtgaatgaagataaaaatatcagttgaattaaatagtgaaaagtaaaggtgagtcttgtttttatatttacaaagaaaccctaattaattaatcatcttagccaacaacatcttagcacacaatctcataacacaatgtttagacagtgacccaatcctagaacatagtatggacttcatttatggttactgaaccaaaggtgatgacatagattttgtaaaataactcagaggaataagttgtttctttacaaagtagcctaataagtactttgtccaaaacaacctacctaggtaccatgattcctgtcagctacatcatcacttctaattctatctgaagatacaattgaaaccactactgaagcaggaaatttccctgaccccttcacgggtggaaactggaatgcatgggcactggaactagctggctgcttcttcggggcggcaggggtggactcccctggctcagtctcactgcattccaccccttgaggaggggagtgcaggtgaacaggtgcaggagccagggcaagtgcttttgggcattggcaggagcaaaactttgtgcggaccctgtggcagtgtctagtgaggagtacccatgacccctgaagccccagaggatgtgagttacagtgtttttttgttttgttttaaacctgtgtaaaaaaaaaatgtaaactaataaatactaatagctttaaatacctaattcaatgtttcttctctttttatttattttttatttttttgagatggagtcttgctctgtcgcccaggctggagtgcagtggcacaatctcggctcactgcaagctctgcctcccgggttcaccccattctcctgccttagcctcctgagtagctggggctacaggcgcccgccaccatgcctgactaatttttttgtatttttagtagaggtggggtttcaccgcattatccaggatggtctctatctcctgacctcgtgatctgcccaccttgacctcccagagtgctgagattataggtgtgagccaccgcgaccagccatgttacagtgttcttttagttttgccatctgtggacagcttaagtcttaaacagctcagtgggccccctgccttttcacgtgtggtggttgctctccaccagcaagggcaaagagtcagtgtgacagtcttcactgtctgcacccatggctcctgagctcttgttcagtgtccaggaaaaatcaggtcttactaacgaattggagggtggtgaatgtggaggattttattgctgatgaaaatggctctctgtggggaggggagctggaaagcagatggagtgggagggcaatcctcccctggagttcagcagtccttggccagactcctctctgaagccacgttgtcaagttgtctctttgaagtcaagctgcttctcttggatatccagttgcttctcttctctgctctctgctgatggagcctggggtttttatgggcacaggattgggggaagagtgggccataggtggttttggaaaaggcaacattcgagtgggaaaacaggaatacatgttctcacattgggccacggttccaggtttgagggtgggacccttgccaaagacctgccctcttctgcccagaatttccctgcctcctatccttatcactactaaggctgtattgtatcaagaaacccaagtgagataaattatattattgcttaacaagtattcactttctatccccttctgtgaaaggaatatattccctacccaattgatgttgaacgtggctatgtgacttgctttttctaatgggatgatagtggaaattatgtgagtagaatttgaaatgtgcttgtgtgatttgacttggtctcctgcactttgatctttttttcataaaaaggatatgtctcagctatcttcagttttaagaaggatgagaaacaagtgaatgtagttcacagctagaaagcaagcctaattgcgccaaatctaaagtagctgaactcatgtcaacccatagatgagtaagaaatggatgcttattggcaagcaggttggtaagtagtttggtataaaagtaatcatgtttttttgtccgtaaaagtaatggtaaaaaccgcaataacttttgcaccaacctaatacatgccaatgagttttgattttttttttacacaatgttattatggatacaaacgactgatacaccaaggaataaaagcatttcatcaatacacaaggagaagaaataattttaaaagttacttaattgtgaaactattggtttaactggtaaaatagttgtacaggtgaaagtttagttttgttatgcatgtaaagacattaataacagaagattttgaaaagtaaagcatccagtgagaaaatataaaaggaaaatgacaaatatagaaaaatcttaggaatgttattggtgaaaggaaggaaaaactaagagtgaagcttgaaggggtattagaaaatggaagccttgttaaatttttgtttctttttttctttaaaggaataaatgatctaaatatatttacaattagaagagaaatatcaatgaagcaagagccctaaaatgcaagggagggacttattaactgatttcaaacaaagctttggctcagctgagttgtgaatgacactctgcacaaagtgaaagagaggaaacaaacttactctgagacaggaggaagaaaagagtaatgttacagataagttctaaagacataaggaagctgtgatcacctagatatgttgaaatgacaagatagatagcaaacaaaggcacttgtgctagatgacctatatttgccaacatgggataaggagattgcatgactgaatatcttggagaagagcacaaacaacttttacttttacttatttattttttttgagatgggcatcctgctctctcgccaggctggagtgcagtggcgcgatcttggctcactgcaacctcagcctcccaggttcaagcaattctcctgcctcagcctccgagtagctaggactacaggcacgcaccaccatgcccagctaatttttatatttttagtagagacgagttttctccatgttggccaggatggtctccatctcttgacctagtgatcagcctgcctcggcctcccaaagtgttgggattacagccatgagccaccatgcccggcgtgtatcaataacaaagatgatggtgacaagagcaaactgtctgaaaattcgatgttatttatattagtaatactacaaactcttagtcttgttaagattaattccaaaatgtgatcttaacgtaaattcgaggattcatttggggcaggcaattcaatgtctaggatccatttacttctgctttcctgtttttaacatagggcaactacagtttcatcttggagaaaagaaaatcatagattttatcaaataacctcatcttttacatgaacaagataactatttactttctctttaaaaataaagcataatgaaactggaccccttccttataccttatacaaaaattaactcaagatagattaaatacttaaatgtaatacataaaaccataaaaaccctagaagaaatcctaggcaataccatccaggacataggcatgggcaaagactacatgactaaaacaccaaaagcaattgcaacaaaagccccagttgacatatgggatctaattaaactaagagcttctgcacagcaaaaaacaaaaccaaaaacaaacaaacaaaaaaacaaaaaacaaaaaactatcattacagtgaacgggcagcctacagaatgggaaaacatttttgcaatccatctgacaaagggctaatatccagaatctacaaggaacttaaacaaatgtacaagaaaaatacaatgctatcaaaaagtgggcgaaggacaggaacaaacacttctcaaaagaagaaatttatgcaggcaacaaacatatgaaaaaaagctcatcttcactggttattagagaaatgcagatcaaaaccacaatgagataccatgtcacaccagttagaatggtgatcattgaaacgtcaggaaacaacagatgctggagaggatgtggagaaataggaatgcttttacgctgttggtgggaatgtaaattagtttaaatgttgtggaagacagtgtggcgattcctgaaggatctagaaccagaaataccatttgatccagcaatcccattactgcgcatatacccaaaggattataaatcattatactaaagagacacatgcacacacatgtttattgcagcattgttcacaatagcaaatatatggaaccaaatcaaatgcccatcaatgttagactggataaagaaaatgtggcacatatataccatggattactatgcagccataaaaaaggatgagttcatgtcctttgtagtgacatggatgaaggtggaaaccatcaatctcagcaaactaacagaggaacagaaaaccaaacaccacatgttctcactcataagtgggagttgaacaatgagaacacatggacacagggagaggaacatcacacactggggcctgtcggggttggggggcaaggggagggatagcattaggagaaatacctaatgttggtgatgggttgctgggtgcagcaaaccaccgtggcacgtgtatacctatgtaacaaacctgcatgttctgcacatgtatcccagaacttaaagtattaaaaaaaaaaaaaagatgttattacctcctggactggattgcagagaaaactgtaaatgttttaacacactagtgtttctactgccaaattcctgttagctcattaattgcattccatatacacctttgcaaatgtttgccctatagtctgtttataaacatcttagatatggcagaaatttaaaaaaaagtaaaagagataaaaaacaacattcatatgaattatactaatttatttttatttttgaattcttattttttgagggaatcgtaagtataaatttactgtatacctagtggcgtatagtaaaattgtaggcataaggataaaaggaaataataaacttcatagtgctcagcttcaaacccaaacctctaaataacaggacaggctcagatacctcagggatcaggcagataatacaaataaatgaaacaggcaaaaaagagtacagtcttgccaagagaggcaatccctacttaactccaactgattgttctcgtttgaaaacacaaatcacaactgccaaatctgattgttcaggagaagccagaaattctgatgtataacgtgaaacctctagatttcttatatggtagcacaattttctctaaaacactaggtaatctaaataaagctgaccatctatcagtttcagtgctgtgttgtgcaaatgatgaatggcatatcccctaattgtggtattagactgcctctcaccagccacaatttgtaattgcaacaatggcatcaccagataggactctcctgctttgctatgcacacattcctgagccctggagaacaactaactctacaggaaaaagtggaaggctcatctaagccattcttgctagctttcatgactagctgctggcctacaggcaataaattcccaactgctcctgcaagtaggctttagggcctgggaggtctttatctggttcagaaggcaaggctgcttctcaaagcacctccaagtgctttggggcccctgttcagatggcaggcatttctggttaccagcacctgatgactgacaggagcagggcagtcatactcacatccaggagcttggtgcttaacagatggtacactgatttcacaacatcatctactctggggatgatccacttggccaccacaatgatgctgctgacagtggttgaagtcttcttttcagcctctgagcccattgtcatggcaacaagtttttctctcaaagtgtgacaaatcttcaagatgacaatgcagtgggacatgagacccaaggcatcctagatccagtcttcattctccagaatgggctctatgccagagtgggcgatgatgacatcatctagttctaactcagagagctcagattgggtctccatggcacccaagagactcataatgggcttagaatcatagcgctgcagcaggtctcctggccagcagtagcgctgcactcaaaccaccaccaagactgcaaacaaagccagaaagatggtagccagcacgcttatggcaacaatcactgtggccttcttgcttctctgtggctcctgacttagtctcactcatatcctcctcataggctaaattttctgaactgtagatgaccagtcccatggcggtgggagcaagctatattaatttattttttaaagaaatgaagaagtattttttaaataccacaaaatatgataccttcaattacgtttaaaacaataaaacaaacgaaacccttagatgacaaatcctagtaacaatattatattgtggtgcttacccaatcacgaatcttctgcccatattgcagatattttaagggaaaaaaaaaaacaagtagaaacaaacaaaaaaatagatttactgctggccatatggagaaattctattttcaataaataatataattcagaaaagctttgttgaggactaaagcgaataagcactttgtaacctttacttctaagaaacattccttttattatccatgtaagttatctatagaaaaaaatatttctagcatgtttttattttttttttaagttttgtttgaagctttgaagtattccttagcaatttgtgtttggagagaaaaactagatatctggcatatgcaataggcacaacttttagtttgcaagtgttttgatgtgattttttccactgaaaatattgctataagagcatagaaatcagaataagttaaatcaatctccttataaaaaattttggggtttgtgtagacaatctgttgtaagttgtttatgactatttctaagtatttctgttagccatttacaattttttgtaaaagttgaggccattctgctccattttctctaagttctctctcaaggaaaaaataaattctacctaaaactacactagaaagtgtgtatatgctcgcacatgtgtccacatggggaagagtagagattggagaaaatgttcacacggacaggaaggggtattactgtgccctctcagaaataaagaacaaaatcaagaacactatgatttttcttaattttaatatatcttttgagtatttgtatatagtgacattctcattaactatgatttcagaacaataggaattctatatttattattctattatttttctattagttctttctctctaatatatgttgcacagaggtatgcttatataaacctaaatatgttaatgaggtgattaagacataatatgcactatattataagactgaagtgtctagtctaaatgacttactttatggtacagtataggttaagttttctgactttgttttttttgagacccagtcatgctctgtcgcccaggctgtagtgcagcggtgcaatctctgctcactgcaagctccatcttccgggttcacgccattctcctgcctcagcctcccgagtggctgagactacaggcgcctgccaccatgcctggctagtttttcgtatttttagtagagacggggtttcaccgtgttagccaggatggtctcgatctcctgacctcgtgatcagcctgccttggcctccaagagtgctgggattacaggcgtgaaccaccgtgcccggccagttttctgacctttttttctgcctcctgtgcactatcttatttatttaaatttggatagtgacacaactgatctgaaaattgcatgaatatactcctttcagataataatatatccatgagaagaaaaaacacaaaatttgaaaaaaattgtataacttatactttgtcttatttaagtatttctactacatagcaagtaaagtatatgagtttgatttcactttcttaaactgaaaggaaaatgattgtacacatttgaataatatattattgaaaccttaatggtattagggacatatcaaaaaagaaatatttacaattgttacaattgatggatagtgtctgacaaaagtatttattttttgacataaatgtagtttggctattgatgaagttgttaggtagcaatttactaatgtgtataatataataaccaatagatacaaattcctatttcatggaggatggaaataaagacaaaataaagaactatgatcacactgggagactgaaaacataagcatataattagattaattgaaatagagcttttttgagttacatatttcagttacaatcaaaccgatagcttagtccttgaagttctataaaagatgaattaaatctaatatatgcaattggttgtatgctcgaaaattagttactgaaattctcaagccctttctatattattacaaaggttttcttctgatagcatatactactggttaataaaaattcacagtaaattcactgaaaatataacaatttaaattttaacaattttgaaacattccacactggatttgaatttattctttccattcccttttcattacatgttttaagaaacttctatgaatattaccttttataaaaatgagatacttaaatacattacatataaatagaaatcatgtagttaaaaataaaattctatttttgagtattgaatgaacaatgaggaaactactgacttcctagaatattttagatatattcaaaataaaattctctaaagagtggttgaagaaataactgaaatgttaatttcttaaaacagtctttactcttttagtggtattgcactaactctatgactcagtgacaataaaactactttaaagtatttttgctagaatcattacagagtattggttacaaaagcttccccaaacttgttcctccctttggcccattctcgtaattgttactattttatcttttctgtagagtctttcctggtaagtcaaatattttcctgtttttaacattatatttctattgcgaaatgagtcctgcttgaggtatttctatatttttgaattagcagtgtttattaagtgcatatgccagttctcaccactgtgtcagacactgagtcaaggctggactatacacgagtgagcaaaatcagataagggaagcttactattgaagaagacagagaataaggtaatcacacaaagaaacataaaataaaaattcacaataattcctacaaagaaaaattgtataaaaatgtgagggacgtgtccttttctaggaaacagaagaatacaatttatcattttatattaccttatgatgtttcattgtgtattttcattttatattagtatagtttgcctttcaaattgtgtgtcacccaaattgtgaagaaacaatgtaatgtactattttttattcatccctttgaatctaggcacataaaagatgtgtctgtagcttactacctgcatgaagaccaatatcattttttgtgatagaaatcttataataatccactgtgatataaaaagtttctggatgtgcatctttaaaaatcataaaatgcatttctttagcaaaacagcctaatcaaatatcattgatatcagtattcttttcttttcctaattcaatattcagttttctttttttaactgtatgctctactttagtaaaagaccaagttttattgggtaaaatataatttatgatgttatataacggtccattttaaaccaaatgcaaccacgctttaacctggtagagaaaaacaatggtaattcattatccaatgatcattgcaaaacatttctctgaagcaaaatctggaaactttcacctctcttttcctaaagctgattcagccacaaagatggcatcacaagcttggcatttggtgtaatttcattttctgctgtcaccatcttgaaatttttaacatttttatcttggaatgtatgttttgcaagtgaggtctgataggtctgataggacaatggaacatgccagtgagcagagctgcttcctttgtagacatcatgcccagtttcttatgaacacagaattcttgtggatccacaacatgcaggagttcaggaagactcagatctactacaaagtcagagtgttgcatgaaccatcgagtaactgtgataaggaaagggagcactgacattctcaagaggtcacagtttccatttgagcaatacttgctttaactgtggaaataatgcaatgatgttctatcatgaatgaaaaactctccatatcctttatttgttttactcctctgtattaaccaaccatcgatgctcaaagccatggttccttttccttatagtctttctttagcttatcactatgctaaaggtatagaggttggtagcatgtgtactatcgagaatgaaataaaaacaattgtgttagtttgtgcagtatttccaccattctgataaggatttgatgtaatttagatatttgtcccctcaaaacctcatattgaaatgtgatctccaatgttgcagatggggtctgggaagttgttgggtcatgaaagggctggatggggctggatccctcatgaatggcttgataccctccctacagtaatgaatgtgttctcactctaatagttagcgtgtgtctgactgtttaaaagaggctggtacatttcttgcttcctctttccttgtgtgacaggtctgttcttccttcaccttgctccataagtaaaagcttccaaaagctttaacagaagtcaagcagatgttggtgccatgcttgtacaaggtgcagaactgtgagccaaataaacctcttttctttataagtaactcagtctcaggtagctctttatggcagtgaaaaacagactaatgcaggataaaatatgtgttgtggaattttggtgatgctactttcaagttaaaggcccttatatttgtataggaaatggcattgcacaatagaaaatgaacagtttagtctatgttcatatttgaaaattttaatttttctttatttaaaacaacaatagtggcaattttaaaaatatcatgacaagatgagagaaaggccatgcaaaaaaggaaaaagactcaaattttagtaattttttttaagatgtaattttgcccttgttgcctaggatggagtgcaatggcacgatcttggctcactgcaacctccgcctcccaggttcaagagattctcctgcctcaggctcccaagtagctgggattacagatgcctgccaccacatcccgctaatttttgtatttttaattttaaccatgttggccaggctggcctcaaacccctgaccttaggtggtcagcccgcttcagtctcccaaagtgctgggattacaggcgtgagccaccatgcctgtccagtaatttaacagtacttttttcttcctgtttgtacaagagtgtcctttttttcactctactgagctggacctctatagcctcagacaatcaaatactctttttcatcatacaaggtagatgggttagtcatgcaacaatcatttcagtcacatctcagtaaatttatgataatcactattttgtttttgaaaactaaaactattcactcacattaagaaattaaaaccatgctgtgatgccatttactggaggaacttgtaatatagtagtttaaaatctaaacaagagacaaaggtgaaaactaaggacaattgtctgtgtataccaaccaaggaagataattatttttatgagttaaactgcaggtttttctttaaagactaaagtttagcaataatgatcatgaccacatataaaataatttctatggtgctagtatcaaaatgttattaccagaaagatctgtttaggcatcttaatctctaatcgtatcagacagattgcatgtgtactaaagtattcaaatttattttctctatatcccagttgtacctattgttctttgctaggtaattccattcagaaccattacttttctatacaacagaagcacctagaataaaaaccttgattgctttcctgaataatattaaaaaatttctatttaccacaaaattctgtaaggaccttaaaacaataccgacattccttcaaattctcagaaattctaaaatgtaatttacataaatgttagggtcctagaataaccctattagggttccttcatccattttgtaggggcaggggaaatataaacaatactattattaggaaaataagtgaataggaaataatgtttttaaactcttattttatgttaatagttgttacacacattaggctaaggtgttaataataaaaaaatataagaaactcttagaactcattagcaaaaaatcaaaccaatcaaaaatctggtggggggtgtatttctagggagaggtaactaaatggtaattgctaataaaacttactgatttcttttcctagtcttaggaactttcttcaagcatttaaagtatgaagagaaagtattctttctcctcctcatcagaacccccagcacaatctacataatcacaataaatttacataaaatacagttatgagcagttctaatacatttcctaaatcttgaaatactttattctattgtttctactatattttcaaattataaaaaaaatatgagaatgaattatctttgttttatacttcagtattaggtcatggaatctacataatggttaaatgattattagtttcttgtatttcaaacactcattaaaagcttatatattctattcaccttggagaacaggtgatctatagaagcagagcaaaatagtttctgtgtccataacttttaatgctaatctttattttagtttactttggtacctaagcaaacctatattctagcataattaagcagaggagagaccatagagcacctacaccacagaacaaagtaaggtgatggctctactctggttgtcacttcccatatgtctgtgagacacattatcatacatgcctgtcattgcacagtaactttgaacatccagctaaaattccagagtctgtccagaaagaatatgtccactttttttttttttttttttactgagtctcgctctgtcacccaggctggagtgcagtggcatgatcttggcccactgcaagctccgcctcctgggttcacaccattctcctgcctcagcctcctgagtagctgggactacaggcgccagccaccacgcctggctaattttttgtatttttagtagacacggggtttcaccatgttagccaggatggtctcgatctcctgacctcgtgatctgcccatctcggcctcccaaagtgctgggattacaggcgtgagccaccgcgcctggccatgaatgttcttaatgacatctagcatgatgaatccttttcagaaggtttttgattgactttgtctagatctaccagagaaatcactgcctatgacagctgcagccttatgaaatgtatttcttaaataataatacttgaaagtcaaaattactccttgatccatgggcttcagaagggaagttacgttagcaggcatgagaacattaatattcttgtacatctccatcagagctcttgggtgaccaggcccctcgtcaataatatttttaattttttttctgctcagtaagtctgaaaaacggacttaacatattcagtaagcaaactgtaaacaaatgtgctgtcatccacgctttgttccattcacagagcacaagcaaagtagatttaacataattcttaagggccttacgatttttggaatggtaaattagcattggcttcaactaaaagtcactagctgcatcagcccctagcaagaggcaacttgtcctttgaagctttgaagccaggcactgaattctctctatctgtgaatgtcctaggtggcatcttctaagaaaaaggctattttatctacattgcaaatctgttatttggttaatcaattatgttagctagatcttctagataactttctgcaacttctacatcagcacttgctccttcaccttgtacttttatgttatggaaatggcttttttaaaaaattaaacattatgaagcaaccactgctggcttcagatttttcttctgcagcttcctcacctctttcagccttcacagaattgaagacagagagtcagggtcttgctctggattagagttttggctaaagagaatgtcatacctggtttgatcttctatccagatcactaaaactttcttcctaggagcaatgaggctgcttctgtttcttactatttacacgttcactggagaaccacttttaattttcttcaaatatttttttttatttgcattcaaaacctggctatttggtgcaagaggcccagatttcagcctgtcttgactttccatatgccttcttcaataggcttagtcatttctagcttttgagttaaagtgagacacatgtaactctttctttcacctaaaaacttagatatcaatatagggttattaattggcttaattttaatatttttatgtctcaccaaatagagagatttgaggagaggagagagctaaagaagagcgagtttgtggagtagtcagaacacacatttactgattgtttgccatcttatatgggtgtggcttatggcccactcaaaacaattacaatagtagcatcaaagatcactaatcatagatcactgtaacagatttaatgacaatgaacaaatttaaaatatagtgaaaattaccaaaaagtgacccagaaacacaaaatgagcacctactgtggcaaaaatggtgtcaataaaattggtcaaaacagggttactaaatacttcgctatcttgaagtgtaatatgatgaagtttgactgtacttaaaactgatcgagagagtagaatttatgttaaatgttcttcacatacacacaagtaataataaaggaggcagtagaaaaatttgggaagtgatggatgtggttatgtccctgatggtagtgatgggttcacaggtgcatacttattctcaagcttattgagttgtaaacattaagtatgtacaactgtttacatgtcaatcatatttaaataagacaattttaacaacaagaaagaaatactcccctgagaatttcaggacctcagagggaatggctccatgatgcacacagggagcttaatcgtgtcattcattcagtttttcagttttgtcaaagcttctcacattacgaggcaagtatgaaagccacaaaatcaccggtgataaaggaattaggttaactgcaaataagaaaatttagtagtgaatacggaagacttaagattaaaggatttagtctctttcctcccatactgtgctatctgctaagatttacttctttgtctgaggacagagtagacatctaaaaatgacctcatttgaattatcttctagtgaaatgagatggaaaccgaggtgacattcaagcagaaacaaaatgaacaaatgtgataaacctaagtttacagcataagactaatatctgctataaaattacattttaaagatttacttattttatagaaataagtctataatttttttgaaccttactggtagtgcctacagaaccatggggtgatttcataaatatgacatgtgtaggtgacaaaagacaaaaggcaccaggcccaatctaaaatgccttttaatttcacatctggccaaaccacataattgctacaattatgtaaatgaaagtctatatttggcaaacttccatataaattttattggttatagaaatagtaaataatgatttactgtcaattttcaattttttttctaatggtaaagagcattcttaactattgatatttttgaaagttatcttcacagaatggtccatgaaaagcagttctgattgcttttcaaagtatctgcagttattttacagtaaaagacatttttcatctcatgagatcaaacagcatggaaataacttaggatatttgtgaaaagtaagagtgttataaattcattgatttaaatatccaaagttctggagaagttacttgatttttttgtttattttattggaaatactatcacattacataagggttagaatatttagaattgttacaaaaagtgtcagaaaataattgataatcttaacttaaaaggaacaaagcacaataccaaattaataagggggaaatgataccaaagtactgctcttctgtagatgaaatacaagtggctatcaaactttagtgattgttacattactctaaaatagagaatactatcatatcattttctatttctagaataattctataatgcatagatgactctttgtaaaatttggtatacattctctacattcatgtctttacatgacattaaaatattgatgaaatatgtggcttaattggcaatcttggcctaaattaagctattacgaagaatcttatgtttctaatatttaaaaaaagcatattttgccattcaatgagctttagaaacaacacagtttttaagcaaatcacctagtagcattattgaatcaattctagttggtaaagaaatcagaaaatgggtcgtaaaccactggggctccacaccactaatctataaattcaattttccagttaaaagagacttaaatcccaagttgggtaagacttggagtgagaaacagatgctgcttgttttgtgcttctaagccaatacggaatctctggaggctgtattcaagagacccaatcaaggcatcttatcacctgcccaatattgggttattctagacattttctaagactcctctcacatgttcctagccaatatagtaactatagtacagtttcaatgtctatacgcaaccagtatcagaatttacggaagtagactaaaagttaaacaatctggcatttatattaacaaaattagttattaaaactttaatttagtaaaacttgaactaaaaacatgtatgtgtaccaaaatgcatgcacattatatatgcagattaaaagtaatgctagttttagagtgtatacactgaaaaaacagttcccttttaagaagaaataaaatatgattgagaaatttttatctcaggtacatttattttaaatttaaaaagtagagaaaaaatcactttaattatgcgaattgctaaaaaaataatatttgacaaaaattgcacactaaaagctcttaaacattatttccagatatactggaaagatttttcttctcagtattgccaaattatttgaaatagatgtttgttattaaaaactctggaacagttatgaaaaaatttctatgtatattttcttacttctctaaaactctcataagcagcatgaggggaaacagtgtgtcatgcaccctacagccctcgtttgtcctaatgggaagacagagtgcgctcatcatatttgataacattttcacacaatttcaaaaagaaaactgtttcatttttttctttgaaacatttctaaaaatacttcaatttagttttcctaaaaaattctgaaaaaactctctaagcatcacaatgactgttctgagatatgtataataaaaatacatgttattaataagatgttaagaaaaccaggattttaaaagtcagtacataaatgtcaatatacaaaatggcagtcatttatgggcttagtaggtgaatagtgaattaaaatgtgcaaaataaaaaatgcagtttattttgttaatgaatatttaactattttattaaagtgaaatttatataacaaaatttagccattttgagttgtaaaattcagtggcatttagtatatcataatattgtataaccatcacctctatcaaggttccaaaatattttcataaccttccaaaaatagactttactcattaaacagttacttaagcgacaatattttaaaacttgttagccactgtaatccagaaaaatggtaccactatgtataaaaataagcagttacttaagcaataatattttaaaacttattagccactgtaatccagaaaaatggtacccctatgtccaaaaatccagaaggggaaaatttcttatggtttttgaaatcttataaaggttctccattggcaagcattatagcttttgttttgttttgtttatctggaataaaatttgaaagcagctctaagtgtagagaagaatcaaatctgattcccttgaataaagtagagggatatatgttatacatttgatctcattccatttcattgcaagcatcacacatatccttaggaagtccttgagtagtagcctccaaaggctagagtgtaccttagggaatgcagaacaggcactgctgggatataagaagaaaacattgaaagttttatttctcatactttaaattttttatttgaagtattgctgtggtttgactagcaataccccaaataaaaatttagaagtatgagaaataaaagttgaatattgttacaagggcaattaaatttcagcatgagtttcaaccaaaactcgtgttgaaatttaattgcccttgtaacaatattaagaggtgggactattaagcgatgtttaggccataagggttccatcctcataagtggattaattaatactattgtcaaggttcattatctcaagaatgagttccttatgaaaagaagagtttgtcacccctactttgccttctctttgcccttcaccatgagataatgtagcaggaagacccttgccagatgctagccccttgatattggacttcctagcctccagaaccatgagccaatacatatatgttcattaaaaaaataacgcatctgtggtagtcggttacagcgtcataaatagactaaggtttgatttttaaacatttacaatataacactacagtaacacatttatgtgttttttaaaccaaaacaagtcataggagaacatgaataaagaatttaggaatcactggatgtctagtatccatcatgttgtttcatgttgatacctcttaagcattttgaattggctccaccacaaggtctatttttagcaatttccatacagactgtatataggctgatgtgcttttgtggaggataaagcaactttgtcagttcatccatcactaataatcctgatactcaaaatcctcctgtaggttgtccaatgccctttggcatagtcataaatatacatgcaattttatgattataagaatttggaaaacttaatcatttcaatttgctatggctgattaattctgctatggtctatggtactggaaacagaagagtactcagatttctggctgctaagagctttcctgcctggagctgtcttcctcaaagcaacagcttggggaatacaaattttctaccactacaaccactctgcaggccacccatctgtaactattctctgggtagaacaacagttagagtaacatacttttaagttagtttttgtgagtgtaaacttataactggatgatgaaaagcaagtaaaactactttgtaatttttggtaaggatcaatgggttatatcatctaggtccagagtaatttttaactaccgttaatttccagagaaggctttcccatagtcattccattagtccaatgcttatttgaaatcttttctcttctctgcatttttctttctggtaacccttatgttggcgtcatttttgaccttgtagttctgtaatcccagaatctttttggtttgtttttgttttgagatggagtctgactctgtagcccaggctggaatgcagtggagcaatctccactcactgcaacctccgcctccccggtcctggttcaagcaattctcctacctcagactccagagtagctgggattacaggcacgcatcaccatgcccagctaatttttgtattttggtagagaccaggtttcaccatgttggccaggctggtcttgaactcctgacctcaagatctgcctgcctcaggctcccaaagtgctgtgattataggcgtgagccaccatgcccagccctagaatcacttaatagcgccttcatttctctctctgatctgtttgagccattagtgtacctaggggaaagacatagcacattcagggatttacattgaaaattctggttctttatacttgtgctttagggtttgtgcacagaattagaatgaccttctttatcttttacaaagtctctcaaaaaaggaatacatgattgggagtgggataattgcatttgtcacttaaattaaaattctgtttttatgtctgctgatgaacatacactttgtcagttgttggttacttctctttgatgtttttcacatatttatttccaatatctgtcatttataccaaccaaggtagtcccaaataaatgtcatcaagaatacagtactgctaagagtgtggagaacatagatttctacaaactaactattggattagcagtgaaattgtactgtgtgatacctacaaagccaagaacattattcagggtaacttttgttcttgtgctacatatttaaagacatgtgattcaccaggaaatacaataaatgtaataataaacacacatcaacacatttcaaatatgctggcattccagctactctaagtaggaaagttatagagcagcgctccccaacattttttggcaccagcgaccagcttcatggaatacaatttttccacagacagggtgaggaggaacggtttcattacacctcagattgggcattagattctcataaggagctgcaacctgcatctcttgcgtgcacagttcacaatagggtttgcactcctgtgagaatctaaggcattagcattaattggcatttatagctcagtatcatctacattccaaacacttaacctaaagaaagttcaatttgctttttcaaaataactcatctatcattgtgttcccagaaggaagggtatctgtggatgctatggagctagagaagacagtgattgagaaaacacagtggaatctgaagcttctatatattgtaattaaccaagtgggcttgggaagaggagatcaaagtctaaaagagcaaaagaatgatagcatgtataatgtcacatactatttaaaattttttaattttttattgttttatgagacggagtctcactctgttgcccaggctggagtgcagtggcatgatctcggctcactgcaacctccacctcccaggttcaagcaattcccctgccccagcctcccgagtagctgggattacagggttgtaccacaatgcccagctaatttttgtatttttagtagaaacggggtttcaccatgttggccaggctggtctcgaactcctgacctcaggtgatccacccgccttggcctcccaaagtgctgggatgacaggcgtgagccaccatgcctggcctaatgccacatatttaactttgctccaaagattcaggtttggaaccatttagaaaattgtaatttcataatttaaaaaatatggtatacaagagattttatgggcaagtatattaaaccctagttcttatcaaaatgaaaatgagatatacaattacattaataaaaattgtaacagactattgatgtagattataccttttgtacaccatttgatcacctagctctatgctttctataaaatctgatttatttaagaccttgttacaacactcagaattttttaaaagcctatgccttctaatatcaaagaacatggactttagaactacttagattgttttgttgagtcagattagggcccacttgtttaaggcatagctaagcaagaaatggttaattacttacatttgaaaatttatcacatgtcaaatactgcaaagtataggtcacatacttgggttcttagtattcataaaaccatatgaacttcttctgctgcttctacaggttgaataattcaacgactattctaaaaaaaaacattttagcaagtcttgctaaattagaaaatagaaatctttaaaacagactgcagaaatttgattctgttgaacagataccatcaaaaactaaagcagatttgaacaacttggactagaaactatgaacaggaatcgatagcccaggttgtctactctggagtccacagtcacaatcactgtgccattgtgtctttttttcatacatattttgatttttaatatttgagtaactgctggcatttaggaagttagaggctagtacgtaatatataatagcaaatattttaatattgctaataatagaatgccttatagtaattcattacttatatcttttaatattattagaagtattataatttctaatagattattagagttgtgtttcattacaaaattttattttgtcatttgggattaatttgactacagaatataagcaattcatctttgcttggtttattttggaaaactccactttttgtgaacataatatctcttacaaaaaggttccaaagtaatttaatactttattatctagttatttttaaagctatattttgggaatattttgctgaaagctaaaattataataaaatagagagcaaaagaagtactttaggtcagcttctctgttacccaggtgtcaaatgataaattcctagattcttctattggacatagatctaaggagtaataggattagttagactgagaataaagaataaatgaaaaaagataaaaccatggctttgagtttagagcactgagagtagtaattttacagcaaataagagggaaagtaaaaaaaaaaaagctttctttttctgaaatattacagagaagctaaatggtaaataatttttttttactataatatgtcatccaaagaaaactactttagaaaaaaaagaaaagataagagctaaggttatacatttgaatgtgatctgcataaagctggatggatcagcttaaaattacaattttaaataaggcatagcagcataagaagaatttctaggttatttaaatttacattttagggttcttttcttctacgatgttggattggaggcttttagagcatctcatccacttggaaatagcaagataatgcatagagactaacactgtgagagtatatagaaggtatatgggaattcactgaaaagcaaaggacacttcagattttagacaagagaaggtgggtgatcagcatgcatggaggcattcggctgagaaaagtaggagccccagtacatgagaggggcagagtccccctgagctgcccctcccttcccatgccaagaacttggtgcagcagcactgtctctgctccacattctgacaaatttcgaggcacttggagcacctattcttctagattaggagtttaggcccctcctttgctgtgtagagaacttgatgcagtggcagttttcatgctacaagcctgggcatatctcctggcttttggtacacctgccaacctggattaggagcttgagttgcccctcccttcccatgcaaagaccttgttgcagcagtagtttctccactccttgcctgggcagagtttttccaggcatatggcacatttgctcccctggttttggagcttaagctgccccacccctcccacgcagaggagttggtggagcagtgctctttccactccacacttagatatctctccaggcatttgaagcaactatacttcccggttaggagtccacgtcacccctttcttccaatgcagagaacttggaggagtggaggtttctccactccacacccgggcacaagtctgggtgttgaatggctgcccccggactcctcattggagctggtgcttgcacctgcctttgagatacctgtaggtggacctgcctggtccagctccaggcagctttgtcccccactctggggctgagcacagagacaaggccacagggcatagcacagactagcccattgcctgaggaaactgagtttctcatggttaacaaagatcattcatatacccatctctttcagccactgttggctcctatctgtaaacaccacctatttgtctggaggtggaactgcacaacctaatagaaaatctgctgacaagagtgctcagacttgaggaacaacataaacttgccaagacctctgctatcacagccccatatgtggcagcaagtctgctcacactcccaggacatcactactacaaccaggatttgagaaagccaccacacaaggctatctgtaaccaatgaacttatactgaatccttgccatttaaagcacccagaaccaaagccaaagaaccctgcacaacatacattataatcacatcctcaaggatgtgactcattaagaaaaaaattaaaaataagaatagacagtttctccagatgagaagaaacagataaacaattctggaactatgaaaacaaccaaccaaacaaacaaacaaacaaacaaaccgtgttacaagccctcaaaggttactctaactcttcagcaatggatcctaaccaaaattaaatttttgaaataccagataaataattcaaaatgtgatttaaaaaaaactcagtgagatccaagagaaagttaaagctaacacaaataaatcagaaagagaatgactcaggatatgaattaaaaatccactgaaaagacagctttttaaaaaataaacaaacataacttttagaggaaaaaattattgaaggaattacaaaatatagttgaaagccttaacaacagactagaccaagcagaagaaagaatttcagagcttgaagacagatattttgaattaaaccagtcagacaaaaataaagaagaatattaaaatataaacactgcattcaaaaaatatgtgattatgtaaagtgtccaatcttatgagtcataggtattgctgagggagaagaagagtaaaaaggttggactatctatttgagggaatgattgaggaaaactaccttagtcttgctaaagatttaaatatccagatacaagaagctcagagaactccaggaagatacattgcaagatggatttcaccaagacatatagttactaggcaatctaaagtcaacatgaaggaaaaaaaatactaaaagcagcaagagtaaagtgtttaatcacctctaaaggacatctcatcagatgaagtggatttctcaattgatacctcagaatacagagatcatcaaagactactagaacagctgcatactcacaaacttaaaaacctagagaaaatggatacattcctggaaacatacaaccctataaaccagaagagactgtggccctatgttcagtcttaaagggaaaaaaactatcagacatgcattttgtatactgctaaacaaggcttaatacatgaaggagaaatagtctttttcagccaaacaaatgctaaggaaattcatcactattagactggtcctacaagaaatcctcaaaggagttcaaacatggagataaaagggtgatgcttgccatcagaaaaacacacagaagtataactcacaggtcttataaaataagtatacaattgagactgcaaagcgaccaggtaaaaacactatgacaggaacagactcacatatcaatattaaccttgaacatgtaccaagtgttcacttaaaagatagagattggtgtaatggaaaacagcaacaacaacaacaaacccaaaaaacaaaaacagggttcagccaaatgctgctttcaagaaacacacttagctgataaagacattttcagactcaaggtaaaggggtggaaaaagatatgccaatggaaaccaaaagagaacaagagtagttatacttacatcagatagaataggctttatatcaaaaaacagtaaaaaaaaaaaagacaaaagaggtcatcagataatgatacagggttcaattcaataaaaagtaaaacaattgtaaatatatatccacccatcaccagagcacccagattcatacaaaaaatgctactagataaaagagatagacagcaatacaatactactgaagtacttcagcaccactaacagcactagatagatcattgaaataaaacaaagagacactaaacttaaaatggactccattgcaatgaacctaatagatgtctacagaacatgctacccaacaatcacagaatatatattcttctcttgagtgcataaaacattccccaagagacaccatattttaggccacaaaacaagtctcaatgaatttggaaaaattaaaatcacatcaaatatatttttaacctcagtggaataaaactagaaatcaattccaaaaggaactctgaaagctatacaaatacaaggaaattaaacaatctattcctgaatgatctttgggtacatgatgaaattaatttggaaattaaaactcttcttgaaaaaatgaaaatggaaacataacatactcaggcttctgggatacagcaaaaacagtgccaagagggtatttttattgtgttacatgcttacatcaaaaagatacaaagttcaaaaattaacaacatatcatcacacctgtataaatgacactactataaatggctatacattcacaacccagaaaaatctaaagaaaatgaataatttcctgaaaacatgcaacttcccaatattgaaccaggaagaaacagaaatcttaaacagaccaataaaaaggagtgaaatagaattagtaatttaaacatctctctggaaaacccaggaccagtcagattcacagctgatgccaccagacatacaaggagaatttggactgatcctactgaaactgttccaaaaagttgaataggagggattcctcctaactggtactatgaagccagtatcagcttgatactgttgccagacaagtacacaacaaaaaaagaaaactacaaaccaatatcactgattaatatagatacaaaaatcttcaataaaatgctagtaaaccaatttcaatagaacattataaagaatacaccaaaattaagtaggtttcattccagttacagaaagatggttcaacgtatgcaaataataaatgtgattcactacataaacatttgataaaaagcatctgatgaaattcagaatccctttatgattaaaaaccctcaacaactaagcttgaagtaagctatctcaaaagtataaaagccatgtatcgcaaagccaacatcatactgaatggagaaaagttaaaaacattccccctaagatactggagcaagacaaggattcccactttcatcagtactattcaacacaataatggaagtctttgccagatcaatcaggcaagagaaagaaataaaagatatccaaaccggaaccgaggaagtcaaattagctctgtttactgacagttgatcttatacctaggaaaccctaaagattactcccgaagactcctagatttgataaatgatatcagtaaagtttcaggataaaaaatcaacatacaaaagtcagtagcatttctatacatcaataacaaacaagttgagaacaaataaagacctaagttccattcataatacctataaaaacctatggaaaatgttctatgaatacatttaaccaaggaggtgaaagatctctacaagacaaagtacaaaacactgatgaaaagaattataggtgacacaagcaaattgaaaaatacctcatgctcatggattggaagaaaccccaaagcaatctatagattcagtgtaattcctctcaaaataccattattgattttcaaggaattgaaagtcctgaaattcttatggaaccaaaacagagtctaaatagcaaaagctattctaaacaaaaataagaaatcttgagaacatacatacacacacacacacacacacacacacacacacacacacacacacacacggaatactatccagccagaaaaataaaagaaatcatgtcttttgcagcagcatggatggaatgggagagcattatcctaagcaacataattcataaacagaatgtcaaatactgcatgttctcacttgtaagtttgagctaaataatgtgtacacaggggcatagagagtggaataatagacactgggaactcacaacagtgggagggtgaggggggtgagggatgagaaattgcctaatgggcacaatatacactattcagatgattattacactcaaggcccagacttcactactgtataatatgtccatgtaataaagctgcacttgtaacccttaaatctataaaaaatgaaagataaatttatagttcatttatgtaaaatgcattttgtgaatctataagttaatacaaattttataaaagtacattcaaacccacatcaaaataatcacttacattgagacttgttctatttgaaattcttctctagcaaatcattagcaaattattaaatatttttctactccaaacagatatgagtatattctatcataatccatgcatacactgacccccaaaattctttaggtattcaacattccatatttgttattttatatgaaaattttgtttcacaatttgttttaaagtccaattccatatagttattttgaaactttttggattttatatttactttatggcaatgtttaaagtttgcagcagtagaaaaactgaactccaaatgattaaaacattaactttccatttaatgtaagtttgtaggcatctactcattttcagtctgagacttttatttgaataaggatcttgcttttttaagcattagatgcacatagaatatgaatgggaatgggaccatggcagaattcaagccataatgccttatagcctggtttcagataccttagatataagattatttcctcaaatttaaggtgtgctgatttatcaagcacatttatgacatttttataatcacatctataagttttaaataacctttcatgttttaaaggacaaggacaattatatatctccaacttgtctttaattttagttgaaaacagaaccttattaaaattggagcgttatacatgtaaaaccactacagagtgtccttttactcagcacagaatacatcttagatgaagttcacaataaaatattcttacatgaacttttgtcttgttttgaatcataagtgtagaaataaagtcctgaatattttctcatgaaacagataattttaaaataacaataacaaatcaaagtcaaaaaattttctgaatttaaaaatacaaagcatcagtgctttttttttttttttaacagatgtgatactccctgatgaagttttctagggagaaagaaaattttaatagagtcactttggccttaggctcatttatatcccttctttgagacttggtagatggatcttcacatatacgtacagaccccaaactaatatctgatttataaaataaaaaattcttagggtgacattgaaggtgctctattacctgtcttcaatatatttttctatccttacctcttattcacatttcaacattcggttttctaaggaagacatactctgttatgacctgatgttttttgtctgtaagaaatgtgcttccttatcatctccccatagaggaatccttctccaacctgaaaagttagtcctgttgatttctccctgactgtctcaggaaaattgactaattttcttcactgctcccacacgtcttgttcagacttctattataactcttagtgcactgccttggaattatctcttaccataactttctttatcaaaagactaaatattttgtggcaaaagacatgcattttttttttatttccagcatattgaggagtggcacattaaatacacaagtatgttttgactgtgtgagtgaatagtagaatacacattttggtagaaaaactatgctatcacgtcttaatttgtatcatttaaaatgtatgcatctgcttaaccaatggttttatcccactcccctaactgacagaatgaatattataccactgtatcaatcagtaaataagtgggttttatgtcttctcactccacctgttctgttccttcttttactgcacagctacatctacaaaagattaattttttttctttttttctttgtgtgtgtgtgtgtgtgtgtgtgtgtgtgtgtgtgtgtgtgttttgtttgtttgtttgagacggagtctcgctctgtcgcccaggcagaagtgcactggcgcgatctcggctcactgcaagcttcgcctcccggcttcacgccgttctcctgcctcagcctcctgagtagctgggactacaggcgcccgcctaagtttttttgtatttttagtagagacggggtttcaccgtgttagtcaggatggtcttgatcgcctgacctcctgatctgcccgcctcggcctcccaaagtgctgggattacaggcgtgagccactgtgcccggcccaaaagattaatttcttaacacgtcaaacacagacatgtctcatctagtacgcacgagttatttgttgagtgtcagtcttgtgctttgttctttgctccaacagttcattgatagggatcctgggaaaaacccctttggaagcctggacattctcccatttacctcactagccactatactctcctctaaataagttaaaacttctgtgtcttggattaaaagcagactaatacaacttgattacaatgtaggggcaaatgacaacatcaaaatataagaggattattggattttgtcaataaaattgaaatttatcactactggggtactactgcttggatagcctggaacttgggtgtttggttttttttgattagagacatgactagactcaactctacaaaggaaagagtttacgacaatcctctctcagtggcaaactgaggaaacagaacttgcacccagtccatgctacaattattgtgcctatagaaatccaccagtggaattacttttctccctctaattaaggacacaaacccagttttatcattccctccactgcagtttggagtgagaaaaagtcagtacacactacatctcttttgacaacagatttcttttctttcatcaacacccagctaggagaataatgggagatggagctaaagtctatttttgttttattaaataaagagtctaccctttgggcaaagagtaatcaatttggatggggagaaaagataaaactctatcaccaatgatagtagaaaattagtcttggccgggcgcagtggctcacgcctgtaatcccagcactttggaaggccgaggtcggcggatcactaggtcaggagatagagaccatcctggctaacacggtgaaacccggtctctactaaaaatacaaaaaaattaaccagacgtgatggcgggcgcctgtagtcccagctactcgggaggctgaggcaggagaatggcgtgaacccgggaggcgaagcttgcagtgagaagagatcactccactgcactccaacctgggcgacagagcgagactccatctcaaaaaagaaaagaaaagaaaagaaaaaaaattagtctgaagttgtaatgagacaacgggtagctatcaagagatacaggatttggggctaggtgatacttgtttcaagcgagacattcctttggactcatcactaattattgtagtgtgaaatcagctcatggatttagtgacatgatacactacttatcaccacttctcttagtctatttgtacaaagtccaattaataacttatttttaggtatttgtaaatatagttttatgtacataattttacttgaaagtaattctgtagtaaatttgcctactgttctaatgaaaataatgtgtctatataaaacaaattgtataagcaaaatcatcctatttttaggcaaatataactaataatttaattacacttatgctcttagttcaacatgtaatcagttgtacagtaagtgcagaattaacactgagaggttaaaaataactagaagttctacatatatttcatagatatagataaaaatatatttaaaatcaaaataaaggaggatttaatcatctaataatccacaaatgattgcaggaattcactctttctgaattatttttaagaacaatcaagagaaaatattaacaattagcaaagagtaaaaccttcaaaaaattttgaaaataaaaactaacagttcactttataaaatgaatagtgtctaacaggacaacatattactgcttattactaccatggataacacctgtatgtattaatgctataaaaatggtcaaaaatgtctcattacaatatttaaacctttgtacaatatttgaggcaaaaaaatgttttcagcacagaaatgcactatacattttgtgggatttacctttgccatactaatcctacatttctgtactgtcattaaaggtaccaattatgtttttaaaatatattttacacttgttggaatgctgagtacaaactttctaaacaaggataatttgatgcaggccacagtgccctctgtcttctcaccccaaatagttgtatagttttttgatctttcccccatcagcatctgtacttttccactctcctttacagcttctgcatgccataaagcttctcctctctttgacactctaggctggtgaggattttcagatattatcttgtatatagagtgaccagctatccaggtttgactaatatgttcccggttttagctctataagttctgtgtcccagaaacccctcagtcctagacaccccaggagggttggtcatcctgttgatactttctacatcatagcttctgatgtaacgctgccatagagtaaaaatggcatcaagctaggttaaggcagaaagagagagagtgagtccgaagaagtctgcttctacccagtccccttttcttcaggttgctatgagaaatgacatgagccaagatacttatcatggccatggcaaagaaagctgataactgagggccaatgtgccctcccagaagacctataaacacaagctgttgtgcaggacagtcctgaatattcatcagtggatcaacaatgtctttaattgcagcttgtcagttggaagtgatgagcaggtccagtgcaaagtgcattcataaggccaagagagagggctgacattcagccagccatggatgcttcggtgggaaccctacaaagtcagaggctgactcagagaactggtaagatgagacatactgaaagaggctggtggtaccagtgaggaattgaggacactttagaacctagccattgtctccaactctttgatgtaactttctgggagaaggagtaggaaggaagtaggagaagcatgttttttgataacttttactaaaaaaattgctttaaatgacaaagaagtgactgaacatttttctgtcacatttttctaccatcagtggatttgggggtttcgtaactctacttgaattcagttagaactatctgcacaagtgggttgagacctaacaacttaaagccattgcaatattctccaggaaattggaaactcaaggctcaggagagatttatgtggagcagtgagggattaaaagacacttaccttctcaatcaagtttagaaaatcagactgtttgaagatcaatcctgaatcctgattatcacttagaatttacttataacttttccttccctgagaaactgagtcagtttctctgcatttgatttaccatctgtaaacaatggataagacctacgtcctcacaagctttttgtgaagattagcagagacaatgtatatttgaagtatacattaagtgctcagcaaaaatggtattaatgttgaatgattagtattattttatttatttatttttgagatggagtctcactctgtggccaggctggaatgcaacctctgcttcctgggtttaagcaattctcctgcctcagcctcccgagcagctgggactactggcgcatgccaccatgcccagctaatttttgtatttttagtagagatggggtttcaccatgttggccaggatggtttctatctactgacctagtgatcggcccacctcggcctcccaaagtgctgggattacaggcgtgagccaccacacctggctgattagtattaaattcttcgaggactaaagaacaaatagaaaaggtaagcacagataggacataatatatagatgtataaaatatcactttccccatgtataatatgatttatagataacatatgaacacataaaaattaccttttgggggagaaaaggagaaatattggttaagagtataaagtttcaattcgataggagaaaatattcttggtgatctgcacagcaaagtgactatacttaataataatgaatgaatgatatattgtatatttcaaaattgttaaaacagtggattttaaatgttcttaccacaaagaaatgataagtatgtgaagtgttatacatgttaattagctgatttgatcattccacaatttatacatgtaactaaacatattgtactccatagaccatataaaattagtagccaattaaaaattaaaatataattttaaaaatgactttgtaatggttgtcatttgtaatggttgtcatgattgactgctgaaaaaaagtaatgaacaacctcacttaacaagttgcagaaggcaaaagctaactactatatttttctgcactattcactcattagggactcaattcactcattacctgcacagccgtctgctagagtatgatcttaaatcatggagtccctgaaaacccaacttggagcaaatatcagttgcttgttatgtttctctgaagagcaacatgagagtgatgtaacaggaaattggggcttattcctctgcctctgttgacagtaagaaatgattaaattctacaaaaaattcatcttttctttttttctgttgtatttcttgctttctccacacagagaagagcgcacatatgcagatggttccaaaactatttatgatgtatttttacatcatgttggagaatgtaaacacacacacatgcacacacacacacacactcacaaccatggtgctcacccctcatagataggaaagtgtttaaaatttatttggtatttgggtctttttctttgcaatactgattatcctgttttatacaccactatgttattgtcttgaaagaaaacaagcatttatagtgtattgattttagcaaatctatctctagtttactttacatttgattgctctagttttgaaatggaatttatttcataaaatactctgtggaatggcatgttagaaatacattccctgtgcaagtatattaataaagttattgaaagtaacttgctgtaaaaccaaactttctgaatgggaattatgaacacaatataaaacagggtattggattgcttgccatggtcattctttaacaaaccttcagtgcttcttttattttgaaaaaatataaatatttgatataatgttaaatattaccacaggaataaatgcaaaagcaataaagttaaattttaaggaactatttttatgggtgtatcagtctgttttcactgtgctataaaagaactaactgagagtgggtattttatgaagaaaagaagtttaattcactcactgttctacaggcttaacaggaagcatgactgggaggactaaggaaacttacaatcatggcagagggcaaaagggaagcaagctccttcttcatatggtggctggagagagagacagagcaaggggagatgtgccacacacttttaaatcatgagatctcatgagaactcactcactatcataaaaacagcatgaggcaaatcctcacaatccaatcacctcccaccaagtcctttccccaacactaaaaatcccaactggagttgagattttggtgggcacacagagccaaacatattattccaaccctggcccctcctaaatctcatgtcctgacatttcaaaatacaatcaagccatcccaacagtcccccaatcttaacttattccagtattaactcaaaagtccaaatccaaagtctcatctgagacaaaacaaatcccttccacctatgagcctataaaataaaaaacaagttagttacttccaagatacagtgggggtacacaaattggataaatcctcccaatctgaaagggagaaactggccaaaacaaaggagctacaggcccaccaagtccaaaacccagttgggcagtcattaaatattaaaggaccaaaataatgccctctgactctatgtctcacatccagggcacatcgatgcaagaggtagtctgccaaggccttgagaagctcctcccctgtggctctgcagggtacagctcctcctgactgctttcatggtctggcattgagggccggaggcttttccaggcacactgtgcaagctgttggtggatctaccattctggggtgaggaggatggtggccctgttctcacagctccactaggcaatggctcagtggggacactatgtgggggctccaaccacacatttcccttctgcactgccctagtagatgttctccctgagggctccgctttgcagctgacttctgcctagaaatccaggcatttccaaacatcttctgaaatctaggcaggagttccaaaacctcaattcttagcttctgtgcatctgcaggcccaacaccacgtggaagctgccaaggcttggggcttgtaccctttgaagccacagcctgagatgtatgttggccctttttagctgtggctgaagctgaagcagctgtgctgcagggtgccatgtctcatggtagcacagggcaatggggccctgggcccagcccacaaaaccaattttccctcctaggcctccaggcctgtgatgggaggggctgccatgaatgtctctgaaatgccctggaggcattctccctattgtgttggttattaacattttgcccatctttacttatgcaaatttatacagcaggcttaaatttctccccaggaaatggggttttcttttctactccattgtcaggctgcacattttccaaacttttatgcactgttccctttttgttttttgtttgtttgtttgtttagacgtagttttgcacttgtcatcctggctggagtgcaatggtatgatcttggctcactgcaacctcggcctcctgggttcaagtgattctcctgcctcagcctcccaagtaggtgggattacaggcatgcaccaccatgcccagctaattttatattttaatagagatatggtatctccatgttggtcaggctggtcttgaactcctgacctcagatgtaccacctaccttggcctcccaaagtgctgggattataggcgtcagccaccgcgcctgccccttccttctttttaaatataagttccaatttcagataatctctttgttcacacatatgagcatatactcttagaaacagccaagtcaaatcttaaatggtttgctgcttagaaatttcttctgccagataccctgaatcatctcaggttcaaagttccacagatctctaaggcaggggaaaaatggcatcagtctctttgctaaagcatagcaagaatgacctttgctccagtttccaataagttcctcatctccatctgagaacaccttagtctggacttcattgtccatatcactagcaccattttggtcaaagccatgccacaagactctaggaagttacaagcttacctgcatctttctgtctccttctgagccctccaaactgttccagcctctgcctgttccccagttccaaagtcacttccacattttcaggtatctttatagcagtgccctattcttttggtaccaattttctatattagtctattttcacactacagtaaagaactacctaggctgggtaatttatgaagaaaagagtttcattgaatcgcagttcctcaggcataacaggaagcatgattgggaggactcagaaaacttacaactatgctacaaggcaaaggtgaagcaagcaccttcttcacatggtggcaggagagaaagaaagagcaagggaggaaatgccacacactttaaactatcagatctcatgagatctcactatcatgagaacagcttggaggaaatctgccccccatgatccaatcacctcccacctggcccctcctccaatactaaggatacaacttgagatgagattctggtggggataccgagccaaaaaaccatatcaatgggtgtatttcagatttaataaattctgaaaatatttagtaccataccttcagcttttcttcattgagctattggcactattttcaagtaattagggtcaaatatattagctaggctatgggaaaaaatgaaatccccctttttttttgtaaaataatatttgtaaaaaaaacatgccatcacacccagctaactctttgtatttttagtagagatggggtttcaccatattggccaggatggtcttaaactcctgacctcaggggatccgcctggctcagcctcccaaagtgctgagattacagacatgagccactgcactggcccctccccttctcttcccttccctgatctgcccttctcctctcctctcctttccttttttctttctctctcctttattctttctttctctatttatttatattttttatgaaaatatatccaacaaggccaaatgcagtggctcacgcctgtaatcccagcactttgggagactgaggtgggcagatcacgaggtcaggagttcaagaccagcctgaccaatatggtgaaactctgtctgtactaataatacaaaaattagatgggcatggttgtgggcgcctataatcccaggtactcaggaggctgaggcaggagaatcacttgaacctgagagacggagtttgcagtgagccaagatcatgccattgcactccagcctgggtgacggagtgaaactccgtctcaaaaaaaaaaaaaaaaaaatatatatatatatatatatatatatatatatataaaatctaacaaattgttcactgtgcccttccactgagaaacaaatacgagatgatttcacagacaaacttagagtgaaatgtattcattattttctaagtctaatatgtacttaatcatttgaacagaatttgagtattttattattttgtgacaataatttgttacttcttaccttaaaggatgctaaggagagcaaaagaataatttgtttatagtgaaaaagcataggttcagtacagtaaaagaaaaactgaaaagaagtcaattattttaagtctacagatcattgaaagttctgaagtcaaatcaaacagtttgaaattttatatgtgatgatatcactggggttaacctcactttatattcacatgagctatatatttttttgctctacaatcaaataaaggtaaaattgtattttttcctttttacattagttttcataagtgaatttaatttttaattggatgtactaattgtacatatttattgtgtactagtgatgttttgatgtatgtaatatatagtgatcacatcagggtaattagcatattcatcataccgtacatttattatgtctttgtattggaatattttaaatcctcctctagctagttgaaagtatataagatattactgctaattatagtcaccctgcagtgctacagaatgctaaaacttattcctcttttctagctgtaattttgtatcctttaccaaatctctccccatcttccctttccccatactctttccagcctctagtattctttgttctatttttctttttctattttttacctttatgatttttattttgcattcatatatgaatgagaacatgagatagataactttctgtttctggcttattacacttaacataatgtcctccagttctttccatattgacacaaataacaaaatttcattcttttgtatggctaaatagtatttaattgtttatatataccacattgtctttattcgttcatctgttgttggacacctaggttgatttcatatcttgactgttgtggatagtgctgcaataaacatggggtacaggtaatctctttgatatactgatttttttccttttggtaaatgcccaatagtgggattgctggatcatatgttagttcaagtcgtagttttttgaggaacctccatatttttctccatagtgactacactggtttacatttccatgagtggtgtatgagctccccctgtttttgcatccttgccatcatttggtatttttttgtgtttttgatagtagccacgctaactggggtgagataataccttattgcgattttgattggcatttcttgtatgataaattgtattatttgatgaataaattatcacctggagcattctaatattcccaatattaacatgaaataaaatttaaattaacctagaataatgaaaaataacaaaatagcaatgtattaaactattctgtttgattcatgtatttcaatatatttcagaataatcataagagatatttaaaagcattctactgtaaattcatattaagattctgcaaagtatttattaaaaataaaatagaacactttgagaaatttcctttttttgaaatagaaaatataaaaaccatgatgataataaaaatgatttttaatgttgccttcatgtatatatttagcaagaggaatactcacacaagatggacaggggtgatgaaattgaattctattttatgagaaatttaaaatggttgaatcagaatctgatggtatgctttagtccttctgaaaagtctattacttttttggtctttaaagaaaattattggcaaggaattctttatataggggtcaccctatgaaaggatgaaccatttcccttaaatgtgtccctggtcatatcagaaagttttattatcacttcagggtagctctctgataaattgataaagacatatttaactgaatttgcaaccataatatgagccctttggtgataaaggtacagaagcaaagctttcttatgatgtgttttggagtttgagaaaaatcagttttccatgaaccacctcaatgagcaaagccctgactgctagatcatcccttatcacaaaaagggcaggctgtttataatcatatcttctacccttccgttattcatgtctgtgaaggcagcaggagatcatgagacacttgtagggccatgacaaggaagagcctacatatcttacattgatgatgctggcaggaaaagtgttggcaattgtgtatgaatggagctagatcctgttgcttccttgagtcaccttgtggcttgtttgctacactccaagccaatgccagctagtcactttcatattaagacaaaaatagatctaattctgcaggtagaaaataagaacctacattacttttttatcatacttatatgaaaactacatggcgtaatgggacagcaactaaagaaggtgcgcctcactctactattacaggcctaaatcatttctttttaggtttatagatgttctgcagataccagctgaactgtgtgttcttatgtaaatgagtatttagtattatttttgctctaaagaatgcctaactctgtttgcctagctcaaaagcagccacagaaagacagaaataaatgagcacagctgtatttgaatacaactctatagacactgaagtttaaattttatataattttatataattttcacattattaaatattattcttgttttaaaattttaaatcataagtttaaaattgctttcccattacgctatgtaataactattgctagctcacgagcagtacaaaaatgggtgtccagatggatttggcctacatagttcccacctgtgtaatagccaatttagtgactacagacacatgtagtaaataaataaccaggtgatttaaacatcgttttataaatgctaagattaaaaagggcaggatatgattggatcacctaaaaaatgtatccagcttgatcttacagaaccacgaaattcttcctgaaggagatgaaaaactgaggtaggaaagatggaaagaaggcatccagctgaacatgagaataaggtgtcaagctaaaggaccagcattggtggaggttaaggagatcaagagagagcaaagcaagtttaaggaactaaaagtattaaagaagagctaaagtgattttgtcaagactatatctacttttcaaatatgtttctgcttcagatatgtatatatatacacacacacatacagatgtaaatatatataaatataaatattcatttattattgttggtagaaataattttttttacttctatccttatattcctttacataagtttgacaatgacttcaacaacagaaattgcttgtctctcaatctttgttttactgcttagtagattctagaaatgttttcttattagcaaggagtaggaaagcctaccactgaagtttgagagattgttttgagaccagtccctattaatactttcttttgactacctcttaaaagaattatacaagcatatttcaggtggaaaggatatgtatatacaaacaggaatagaaatggtttgtaaagaaatgaaaagttattgttttaaagaaattatatcaaatactatttgttttttgtccgctgataaaaagaacatggaaagctatataggtatgattatttcaaacagtcgtattcagaaaagacaaacaagctattctcagagtagtggtggtgatcactaattgttttaaaaacaattccaaaaggatttatcccatatgaaaatgggttaactcaccagtgtactttaatagaaattgtagacatattgacccataatggttgccagtgcttctgaggttcactgtttcactaaatttcctttaaactcaatcgtcgaaactaggtgcagctttacagtaggtgagtttggaaagactttgaaggtatgcaacatcactatcacagtcaaagtgctctttaaaatgcatcatatttctaggtgaattattattattagtagcagtattcataaaggaacctcaaatgagcttttgcatttacaaaccgaaggtttagtttgtacaaagcattttaaaaatattgaagtctgtgacattagagcccgtctttgtaggttacttccttctacagcacagcagaagtttgtacattcttagaaactcataattatgaggaataaatacttttttgatcaagagggatataatatattgcaattcaaacaagtccaaattgccaaatacaattgttttaactgagcccttgtctgtttgaaatttccttgatatttaacactgatgagcgccaattccccttctgaaacttgctattcctttgattccaggatatctctcattccataatctcattctctttaacaactattcaaattcttcacttttccttctatgctatatatataatttctcaaacttttgctatattattgtatatagtattaatttctagtctcaaatttcttatgtatctatagctagatcccctttcttattcctagtatttgtgattctcctctttctgaattgccaaatatttgcctatgttatgagacttttcaaataactatcttgtgtttttgttgataaaatctacacttttgtcattactttatatgttgatgttcctgtattatttcatattgattttgatttctattttacttaggaatgctctctctacttattttggaattaatttgtttttcttatttttctttagcttacttgctttaatttatccattataaattgctattaagtttactgcatacatttcacattacacatttttctttgtactactttgcataagtttttagtatgtagggcttcattgcaattcattcctaaacagcttataacttctgttttgatttcactttcatcttaggaattctgtaagctgctttcattttagtttgttgttaatttcatttttaaattgttttgtgttcaataaatatggtctaaaagacttctgccttacagaatttattgattatcttgtgctttcatacatgttcattttgctctgagtttattcatgtctcaaaagaaggctccctttttgtctgctgtatgcaatgttctaaatgtaagaactagtcacctcattgcattatgcagatattctgtgttcttattgtttttaatctatcttttgtattcagagagaagttcctatttgattgtattttaaacattttttcatctctcgtgtaaatagatactgctttattatttttcaaaatgttaatataataagaaatatcctgtttcatttagtagtttttcacatggaatccttctttcttttttggcattttcctgttatttttgaccaacaattaattttataaaaatatatctttattcatctttttgagaataatacatggttggtgttttccagtctaactaatctgtttttagggaatccattttggggtagactttcatacattctctcctatatcagctgtcctgtttagcatggtcttcatcttccatattggttgtttttcaaaagtttgtgaacatggttgtctaattagttttgaatatgagtatctgttgatttgtgtaagtagctgtatcagcttttcttttgaatttttgtagttacatagtttttgtatacatttatggggtacatgggatattttaatacaggcatacaatgcataataatcacatcagggtgaatgggatatccatcacctcaagtatttatcctttctttgtgttacagacaattcaattatagtctcttagttattttaaaatctacagtaaactactgttgactgtagccatgctgttgtgctatcaaatactagaacttaccacttttatctaactatatttttgtatccattaactatccctacgtactctgcctcctccactacccttcctagtctttggcaatcattgttctactccctttctccatgagttcaatggttttaatttttatctcccacaaataagtgagaacatgtgaaatttgtctttctttgcctgggttatttcacttaacattatgtcttttagtttcatccacgttgttgcaaatatatctttgttctgttggtatgtagttctcaggatacctgcgtcctaactaggaaggtttcctcaaacttcttctacatggatatggcatagttcattaggttatgtggatacagaaagaggaagagtgacatatcctttctcaacttttcttttccacttttaaattcagggggatgtggacaggtttgttacatggataatttgcatgtcacaaagatttggtgtacagattatttcttcacccacgttttcagaatagtactcaataggtagtttttcaatcctcaccctactcacactttccaccctcaagtagtccctggtgtctgttggttccttctttgttttcatatgtactcaatgtttaatccccacttataagtgagaacatgtggtatttggtttactgttcctaagttggtttgcttaggatatggcttctagctccatccatgttgctgcaaagggcatgatctcattcttttttatggctgcataatattccatggtatatatgtacattttctcaattcagtctaccagtgatgagcactcaggttggttccatgcttttgccaccgtgaatattgctgcaatgaatatacatgtgcatgtgtctttatggtagaacgatttatagtcttttggatatgctcaataatgggattgctggatcgaatgttaattctgttttaagctctctgagaaattgccagactgcattctacaatgggtgaactacattacattcccaccagcagtgtataagcattaaattttctctgcaatctcaccagaatctgttattttggactccttaataatagtctttctgactgttgtgagatggtatctcattgtggttttgatttgcatctctctaatgattagagatgttgagtattttttcatatgtatgttggccatctgtatgtcatcttttgaaaagtgtctgttcatgtcctttgcccactttgtaatggagttgtttgttttttgcttgcacatttcaagttttcaaatattttctcccattctgtaggttgtctgtttactctgttgattgtttcttttgctgtgcagaagctctttagtttaattaggtcctatttgtcaacttttgtttttgttgaaattgcttttggcatctttatcatgaaaactttgccagatcctatgtccagataatgaggtctttactgtaagactggagcatttttgtttacttctgtcaaatcccttatgaattacctttcattattacacatacttatgcattttgttttataaaaatacagaacactaaatacacaaaaactctagattctacccacgtgatcctggttgcacttctgaggctttcccaggattaatttttggggagagattggggaaactgaagataatttttcaaggtgtctcctcttatctttccttataatccctcttcttttacggaataaggaaggggaaacagcaggaaaatgttaacataagtccatagttgtaactgcaaaggcttgtgattggtattatttaatgttgacttgcagatttatctccactcaatctgggagcacacctagacctgcagagggaagggaaagcataaaggtacctgctatcaccatgcatctgcttagtgtggagtagattatagcattagctcaccatttacctccatacaccagtttctcaattcagcaatgggtcctatgtggatctgtggcttaagttagttaatagccagtacaaggacttcattttctgtccttgaacctcagtctgttatgtataaattatagttcctaaaactgaatctcctgataacatgtgcctgctgcttaagtctcagtcagccctaatctggccaatcagatagactccaaattcctcaccttgatttgaaacttcccactgtaaaatttacttttctcagactaaattttgggcccatctttccctgtaactctctcctttcctaaatttatgaccccttatctgacaccttgcctttttctgatatttgacatgcttaaatctaattctttcttctggcactaaattagagtgctataaaatatttgtatttgcaactatttcatgtttatcttacagactcgtttttgtcactagggaaaggtatttctagtgcctatcagataagtaaatagcctgtaaatagggagtgcaaactcgaatgcctagagatgtccgtgacagataatgtaaacaagtgaaactctcctgggataaaacagcaggagggggtaactgctgaaaaccttacgactgtttaaagacattccaaatcaaattatttctaaaaatcagtaaaatatgagtcaacaaacagacaaacaaaacaagtgtggtctgcattgccaccttgagtaactcctctaaaccaaatagacttctgctcatccttgcaaggccacatccagccattaggtaacttcttgtttgcctcccataaaggctgttcatatagttaatttttgacatgcttttacctcaataaaattatcctgaggcaataggatagaagataaaccttggttcaaaccccaactttgccacttaaaactgaaccaccgcacggcaagttattaaattttaggagcttcattgttctcttttataaaacgggcataaaaatgtatgtaataaattattgttgggaagattaaatataatctaagaaagagattataggaaaaaatcaaacatttcatgttaatcctcttttctgtcatacatgttctccaaatattgatgtttttctctaggccacaaaattttcttaagagtaatcctacctatagcagttggaagtcaggaccacagtatttttgaaagacaaatatttacaatctattataaaaatttccaatatcatttttgtttttatttggaaatatcttcatgaattcctattcaatattcaaaacatcacaaatatgtagaaaaggggataaacatcaaggtagtacaatatatctaattttttggttgaatcaaaaatttaaaatatagctgctagctgttttgtgttttgtttctatgtagacttatctctcagtaatgatgatgcttcaaaagaacacatctatatcaggttctatctctacacaccctttactattatcaacttgtaaaatgtatcagccaaacaggacctgctacaggattgctgatgtctataaaaatgcagaaagcactaaatcaaaacgggctgctgaaaaactaaaaatcaaatatcacacaaatcactcagctgcctgggcttagaaagagagcatttgaaagctcatatgtggactgatattgccaattgacatactcggttgttttaagcaaatcttttaaaaattcattgcttgaggagatcgagcaaacctgtttttctggccagatatgcttttcctatttccctggcttatgaagtttcacaggatgagttttaaattactcaggaaatagctatagggtatcctatttacatcataaaagatatactgacagaactgcagggtttacgccaatctataacaccagacaaagatttttcactgtgctgcaggttttataaggagacatttaaaaacatatataggaaaaatataatcctttatatgctatttaaatatattctctggctatctgaaaggctttctattctttgaaggaaaaattctattcccttttttttgctgactactgctctttgtgtgtagttatatgaaattatcagaaatattaaggctatctatatgtactatatttaaagtgggactcttctgagctcatcacatgtctcatcattagcctttcacatatatttcaaataaaaatgtaattatattagtaataatgcttttggtgcttagggaatgaataacacttgccacactgtccagttggtatcttagactaaaatagttgacacttgctgaaaatttttcctatgcttcattagcttactaagtgagacaggaacattcctgtcattgggatctttgctagatttctgatgttatgttagtttattctcatgctgctataaggacatgcctgaggctaggaaatttataaaggaaagaggtctaattgactcacagttcggcatggctgcggaggcctcaggaaacttacaatcatgacagaaggcacctcttcacaggagagcaggagagagaatgagagcccagtgaaggggaaagcccctttttaaaccatcacatcttatgataactaactcactatcatgagaacaagatggggggaacccccatgattcaattacattcaagaactacaattcaagatgagatttgggtggggcacagctaaaccatatcagatgttatctaattatatagtagactgggatataaaatagacaaggcagactgttgtattaagtggaaactctagtttatagatattaacatgattttaggtattattctttataccttagattctcaaagcacttgataaataatgaccctaaattggtggtgaacatgctgttggagtgttgaatccaataaagttaaataaacaaaagaaagaaatggcatctaaaaggacaaaaaaataaggtacttaaggctctgcacctatttttctgtgtttatagtgccttaaatatcaccctctgaccaagaagtaatgaacgggtttggggcttttcttaatgtgttttatacttgctttattgctaatatattgattagtttcctaatgagatcacagcaaagttgttacttctaaataaaagctttgccacaaaggttgcaagtaatgaacactataaactgtatgtaataaaatgtttgcaaatagtcatcctttggttcatatataaggtattctggagaaataaaaacttccatgaatttattttatactttttccagcaatcctaaatgctaacaacaacacactattttaatctgaggaaattgccatgaatttgaaaataatctcaacactttgaaggaattaataaaaacaaagagttgtgtacatattcaattccagtagataatattacagtatcatagatatattaattaagaatatgaatgtttaaggataattcttaagtttcaatgagattccaacccaattaaacaacaaagatatgtttcccttttaaattatctagttgacttaatctattgcttttagaaaaggattgttagaagtaatatgatagtgatgaataacccaaggtttcattactgccaagaatccagaatgtgtttacatatctctcagatgccagaagaacttggacaggagcgaatgccttcatgattggtgaagaatttttcttgccttgactggtaattgtctgaatcttctagtagtgatcttacctcttgttttgaagttgagaatatgaatactcatgaagagaaaaggagaggagacacatttgaattgagcttcaaggtattaaataaaatgttgcttgtccagcatccaaagaaatctgcaaaatctgcaaaatcttaggctccaagcactagtggtctaaaatgaaaataacccaagatatccatcagggttatgcaaacaataggggaagacaatctgcccttgggcattttcttctcttcttttgtcacacaggtctacccagctataatggaatacaactaagagagcttcttgttcgttggctgcttctctctgagaatttaaacatgaatctctcactaaaaaatgtggcttggtcaagagaatgacagataagccagcaactgggataacatattttcgaaacacattaactgataatgaactggtattcaaaatatacaaaaactcctaaaaaccaccaccaacaacaacaaaactacatcacaagcaaaagatcctaataaatgtttcaccaaataagatatacagatggcaaataagcatatgtagctatccacacgatttcttaaaacccatcaacaacaacaaaattacattatgtgcaaaagatcccaatagatgcttcaccaaataagatgtacagatggcaaataagcatatgtagctatccacgctatttgtcatcagagaattgcaaattaaaacatcactacatcacctattagaatgggtaaaacacaaaacactgacaacaccaaatactggcaagtatgcggagcaacaggaactcccaatcatttctggtgaaattgcaaaaatgatacaaccactttgaaagacagtttggcagtttcttacaaaagtaaacatattcttaccatataatccagcaattacactctttggaatttaccaaagtaaattgaaaatttgtgtacactcaaaaacctgccacaaatatgtatagcaggtttgtttctaattgccaaaacttggaagtatttaaaatattcttcagtaggtgaatgaataaatgaactgaagtatatctatacaatagaatatgtttcagggatggaaaaatgagctacctaaccacaaaaatgacatggaggacacttagacccatatggctaagtgaggaagccaatctgaaaagtctatatactgtatgattcttattatatgacattctggaaagaaaaaaccatggagactataaaaagatcagcgtttgccaggagttgggttgggggaagggaagaatagaggaagcataggatttttagggcagttaaaatattctgtataattctgtaatggtggatacatgccattatacattagttatacctattgaacgtacaacacaacaaatgaactctaatgtaaaacatggactttagttaacaataatgtaccaaaattagcttatcaattataatgtgtcccatgaatgcaagatgttgataaaagaggaaactggggtggaaggagggatatgtttatagaaactcttcccacttctcactcaatatttctgtaaaactaaaactgctcaaaaacataagagctataaattaaacattattttaaaatgctgtttgatagattagtgataaaatggagaggctggaactggtttagtaattactagtgctctcctgcctggggatcacctctctccaagggccaccataaatgctaacttatataaatgatgctctctagatttatgcaatacttaactacaaagagatatgaaataacaacatcttaatctcttcttaaactcaagaatgaacacaatccagggcttggtttttgtgctttttgaacatagagactagagattaatatctccatgtgaacatgagctaaataagtagatatctgggagagatcaccaatataaaggaaaaatgacatatgtaaatgaagcagattttaaatcaaaggattaaaaataaccatgtcatttagccttatgtatgtaaaggaagacactagtaataagaggctgaaataagattttatttaaatgtggatttttgacatatgaaaaatataatggttgaagaaaagaaaatggtagatgggatttttaaacatcaggattattactactgaagaaagaattatggatggagccattaatctaaacgaaataactcagaaacagaaaatcaaatactacacgttctcacttataagtgggagctaaccaatgggcacacatggacttaaagatggggaaataacagacactggggactccagaaggggagagggaaggacggggttgagggttgaacaattatctgttgggtacaatgttcattattgggcgatggatgcattagaagccaaacctcaccattatgcaatatatccacgtaacaaacttgaacacatattccctaatccataataataataaaataatcctgcaatgaaaggcaaaaaataaattaattcatctgggatagctggaatcctgtgacccaagtgaagaccatgaaatttataaaataattattaattcttgccaaaaatattctttaaaaaaattattctatagaggaattcaccattttttatttcctttcaccagtgtcttggaattattttctaagaataaattcacaggcaaaggaatgaatgtgtatatatgcttctcaaataacagtctaatgtgggaaattaagaaacaaaaataaggggataaggtttatatttctttacatcacagttgatttgtaaaattaatatgttttatattcatcgattctattgattctaggacagaggtggtactcaagactcaaggtattagaatccttgtctgtcacagggacaaattcttaccaggagaggataggaagtgcctgcagggtagagttgacagatttggcaaataaaaatagaggatacccagttaaatgtgaatttcaggtaaataatgaacattttttttagaataggtatttcccaaatatcgcatgtgtctttcatactgataagctagccccaccacagacctattgaatcagaatttgtggggatagggactaaggcatctagtttgtataaaaattcgtcagtaattctaataggcagacaaggttgaggctcactatgtttaacgattatttatcaatcaaacctcctataagatatatgaaatgacacttatggccgggcggtggctcacgcctgtaatcccagcactttgggaggctgaggcaggagaacggcgtgaacccaggaggcggagtttgcagtgagccgagattgcgctactgcactccagcctgggcgacagagcatgactccgtctcaaaaaaaaaaaaaaaaaaaagaaatgacacttatgaggccatgaccacacaacaaatccagatatggataaccctcagcccttgggcgtcatgttgactatgatattctgtgttggttgatgactgctatcaagttttcaattttatcctggttttctttttcatacattggagaacaagctacaagccccactacccccaataatttcctcattttcaaagtcatcagggaatgtgtgcaaaaataaaaataatgcctgctataaaactgtttaactactgtgtgaaaaattgaatttccaacataactcatattatgtttcctctcataaaacatgaaatggttgaagatgctaaatatggcacagtggatatgaaattgattatatcaggaaatctagtcatctgtttcctggctatgccatttaacttctttgggcctcaatttcttcaccagtaaaacgatgttttgtcttgttgactgcccacttttaaatgtctgtaagatttagtgtttacaatgtctcttggaaacactaaggttggtattcataagttattggcagatcatatgttttaacaagaatgttgtagaaacaaaatagattatcatctgtatttatgccccatacttgtcatctgagagaattcttaaatgcaattcaatgtagattacaaatttgcagtctacaattgataatcacactgtgaaccttccagaatattgaaactctattttagaggaaacaaatgtgtcttgctttaggcttacctgcagaaatagtcaataccctatttagggtcatgaagcaggcacaacgaaattttcatgaatattaattgagatttagcttgcaaaatgaacatggaaatatctctcagatactgcccatcttttaaggactgacactaaagtaaggctttcctttaaataatatttaatagactaatatactctttttccttctaatttttaagctaggataagtgcattccacattaaaaaactgttctctttaaaaaacttaactgcatatgatggtgatggatgattacttttcttcatttcaagtttattgggtctatctcctagtttatttgtatgttttaaccaatgcatctgattatattaatctcaagatgaaataaatgtgccattaaagtccatatgtaaaagaatagtttaaagttatgaaaataggccagttctcaattacatatattttttgttcaccattaagtaatttatcactggttcattttagggcacttgtatttttagtatttacgattcaagtacattacagtagtcctttcttatctggagcttggctttccatagtttaaattaccaatggtcagccatcttctcaaaatgttaaataaaaatccagaaataaacaattcataacttttaagttgcatgccatgcttagtagtgtgatgaaatcgtgcactgccctgtttagtcctgtctgggacgtgaatcatccttttgtccagtatccacaccgtaggcactacccacctatcagtcacatagcagccatcttggtcatcagattgactgtcatggtatcacagtgcttgtgtcctagtaacccttattttacttttattacagaatattactatgattgtcctatttcattactagctattattgttattctcttactgtgcctaatttatgaactaaaccttatcctatatacatatcctatatacatatacatatcctatatacatatcctatatacatatatcctatatacatatatacatattatatatacataatataattaggtttcagtactatccgtggattcagtcatctgctagaggtcttactgccatggggaaggcggaactactctactgcaatcaatttatatcttcattatgtgctaaaggaaaattaattttaagaaattcaggtaaaactatattcacgttctcttatgtggcttttcatatctaaaattattatacatattgtgctgatacataaatacaaattgtaaaatgtgtcctatgtaaataaagatggaaatcagaattcaataatatttcaatggctataccatttaaaaatacacatgtatagtcaatgaatacaatttttaaaatgctataattttttagccaaagcttttatctttcatttgagaacttgaagactgtcagcaaatttcaaaggctttaatcatccaaatttttttaacattccaaagtattaaatattccaaaagtagattcgaactttctttaccccaactctgctttaggaaccctagttcagtcaatgattctcaaaactgaaaattattttagagacagaaagtcttctttgagataaatttaacaaaaatttaatcaaaatattacttttaaatgttatctggaggggagaatatggtatgttcatgaccttacagagtttatgtacatattttgaagcttaccataaactttgcttttaattggttactatatgtgattaacatcaactatcccaacacttaagttatttttataattctcaatattatttgtgatatctttctaatcaatatttttgagttttacctatttttattgaattatctttcttttcttttttgtttctgtaaatttgtattcattgtttattttttaaatttccttccttctactatctttaaaataattgttttttcctaatttttaaattagattattagtgtagcagttgtatatactttatatatatgtccgtgatataagatctattccctataatttcatttttattttgtgaagctttattaagtttttttaaacctttttatttggtcacaaacactaacattgttgcactgtgaataggtaatatggtttgctagctatcttgcttattgtcttccccctttactggaatttaagatttctgagggcaggattttttgactgctttactcattgttatgtcctctgaaccagaagagagcctggcacatcataaacctcaataattacttgttgagtaaattatttcattctagaggtttcagctgtcttagatcagtttttatattactgcttgttgttgttgttgttgttgtttggatttctataacaaatgactgtgtaaattcaagccatcaaccacttttcacacagactggcattttcaaattctcgggttttttttccccttcacttattgcttgtgttggatagaaagttctcttaatatcagtattgctttgttctgatgtgtaaagtgtctctaggtctccagttcacagattgtacagcccttagatcagttgtattcgaggccccttttctgccctctgacttgggagaacacaagatgtcttctgtttctgtaacagtcattaaaatcctgtcctaagctggacatggtggtttgtgcctaccattccagtgacttgggagactgagctgagaggaactcctgaacccaggagtatgaggccaacctgggcaacataacacctccatttctaaaaaatcaaataaaaataaatcctgaactgcaatttcaagaaaatgttctaatgcatatttaagcctgtcactacttcagttgccagcgtttcagctaaaatatacaatctatctttaatttcctttttatttctagccctagggatttctttctttccagcttagttagctgttaaaattttccttacatgttttatctagcatttttatgtgtatgtactaatcaatcttgtttaaatctcacagtctttaagtcttgattggaaatgaatatagccaaatcttgctggcctaaaactgtttcatttctttgagaaaatgtgaacaaattacctaaggtcattttctgaaagcagccataattttcttatttcagaattcctacagctctttgttagacaaaaagattgagcaccaccaggttagaatttctcatcttaaacatatgcttccttattctcatgaaaatactctgtctttatccaaagagattgttcttaggatcccaaaataaacatatttcaccttctgaaacatatttacagtctcgacaataaacatcatgtaatagtatcataacctgatagctaccagtatagccaaaaccaagcttatttattcaacaaatatttgttgcactttgattatttgtcaagcactatttttatgatgtattgtgctagttgctggaggtataaatttaaataaagtagataaagtccttgtcatcatagatcttattttctgatagggaaaactgtcaagaatagcaaatccaggttaacccagacccaactgaatctttcaaaatgtcagtaaatacttctaaatgtcctcctatgtgccagtgtggcaatcaccaacaaaataagaattcctgttgtgtgtatcttatagtcaagtagggaataaaggcactaaatgctgcaaagaattaagtaaataatcgtaactgtgcaaagtataggctgagagaaaaatggaatattttagaaattctagcagaatataactcaggttttacaatgagcccatctagcttagctagactgagctttgacctttagacttggtagtctttactggttctacatttttttttttttttttggttttaagaagcagagggtttaataggcaaaaaggggcaagaaggaagggagaaggaagaagctcccctgtacagagacagaggggtgggcactccaaagccgagagacagaaccccaagtgtggcggaaaccagccaggtgtatatatagacgttggaagaggcagtgtctgatttgcatagggctcaggggattggtttgaccaggcatgtcattcacctagcccacgaaaaagctggctctcccaccctagtcttttaatatgcaaatgcagggcaccatgatgttctacacacatggggatatgcgggggcagtcatgttgccagcaacatgtggggcaggggcactggttctacttttttatcatgtcattcattctatctctcttgacaccataccggggtccccactgggtcatattaggtaatttctaattgctgatgttgattctcagtccaggtttacctctcagagcatctggtccaggtgttatctgtaaatcttacacccttctttaaaacttaaatgtctctcaacatgattttttaaaaaattattccttccccaggggacctgaccttggcatagcagactgtgccttggttagaattttaaccttctttggagctactctagtgataaatcctggggctggcactcagctttctctgacttcactctgaggagatgaggcccttttcatatgctgccaagagagtttgctgagtttcactcttggctttcaattacttgttaaccacccttagcattttgttatcctttttctagaggtcagtagagtttggcaatagcatgcaatccaattgctcttgaagctactatttccctcgcgcttttcaacatcaaaccagttagtggattcctctttcactgatatatcccaattcaccaccagtgaaagttgcatgattttatgagtcccttgtgccagtagaatctagactccgtgtgctcagtagtgcgttcctcattgccagctaggcaatgagaggtctagctcaaagagtagttttatcacttgcattttcagaaaactcctgacataaattaccatattttggattcattatttgattcctatacatgattgattgtttgggtggtataaaattggaaagacatttttcctaaagttttgcaagcattgttcccttgacttatgacttttgatattatacttgagaatttttacttatcctttgcatattatttttaaaaactttgtttttttttctctatgttgaaaagctcagaaaatattttctgttttcttttcatttgaaaatttgaaatggtctcattattctgattgtttccaggcctttgttgagcccttcacaatctaaaaatgaatgaactttagtttcaggaaacaataatgaattattcctttttacttcctctttcctgttatctctttctgaaatattaagaatcagatgtaaactaataatatgtctatatattatttatagataataatacatatataacattttataatatatatatcagtataaatattttattaattttctcattttctcattttacttctgtgtggcttttctttgggggagaatttgctttctgggaaatctgcttaattttatatttcaagctttctctttaattttcaatttttcctattttctcagtttagagaagctctttttctgttatctgggtttcccttttacatcatgcccctttgtaactgttgtttttaaatgggtgaatatgctgcttgtctatctgagtataataattatatttttgaagcttttttttctgtttcctacattgcttacaatttctccctcttcaatgtttctggggttgtttgtttgttttaagtgttagaagatttatccagagatctaacaatccctatctgtctgctcatacttaagaataaggaactaaatatcagattggaagttatttaggcatttacagaattttaaggatctggtacagattaagttgaccaaggagggatccggctgtttcagtaatacctccaactgttaatttttctttccctgaggtgggggagctggtcctacctacggcctggaaatcagaagcttgagtgactgtgatctggcagctgagtaggaagagaggtgtggaccttcaacactcagtgcgtagacctccattaaccccagtttccacacggcactcccatctctagtgatgcctattgttcaaaattgcaaattccttccattttaacatttccagagaaaaacttttcaaaattgtttttaggtgttcatgtgtatgtttgttgcgtgagacgtggtagaggggataacagtgcttggaatggagagtatccaggggtctaaatgcttctaacactgatattcaagtgacttcccgtttcagctccatccacacaacctggccttcacaggcagcaagcgtctccaattctccatcttttaaagagttattcaatggcagtttcattgcttcttaatttctttccctattgtcacttacttctcttgtctgcaaactaaattacaaatgggcatttttaaaaaagatgttaatacatcttttctcttgtgacttcctgtccttgtctcttctttgctttatggaattacatttttaataaatattttaatagttattttgtagtgtttgtggagtttgtagtggtaaagatgtgtttaatctgctacttgtaacccaaaacccgtaagtcacctcaataaagtgattgcaattttcaacctctcattcagcacccccatccagttattcaacaacttattcaattcaaacactggaatatatctccagtcagcccaataatctccatttcctatgctactatacaatgtcaagccaccatagtatttgacctaagtcacaattccagtcttatccacttctattttcaactgaaacaaatgtatttatctttctaaaatacaaagatgactgttattttcctccttacaagatttttaacaatttttctaattcctagaaatactttctaaactgcttcgtaatgcacacaaatcacttgagaccctgattctcagccatctctctttgtgcttggattacattcaatttatgatacatccttctgcctttcttaaccagaggaacatgaacatggggtgaagcatgcacatacacgttctctcatacacacacatgctaacatgctccatcaatattaatgtacttacaagtctataaacatgcaagaatttttttatactggactaccaaccaccaaattgtccactaaaataatgtctttctttatatttttaataccgtagtttagctgtaacccataccaaggtgcccttcctgattctgtgttagacaatatgttcacataatactttccatttatccaaaattatcattatcacattgtatcgaattctctttctccttcccctgtacaccacttcctgtgctctaacctcaagactgtaagcctttcttttttttaaaactgcaagctctttaaagaatccttgtgtcttttcctgtatctaattttaatttctgatatactacatggcacagcagatgctcagtaagtatctgataagccagcatccaatgactactacaaggaaagcgatgggattctaaagttgtatgatatatatatatatatataaatgtcaaaaagctaggggaatatgaataatcttcgttataactagtttgtggtgggaagcaatatatcattagatttgttcttttttttacgaggaagatacaacaaataaatccttataaaaacagccaataaatcatttatcatcatattgattttctcactagatttgttttttaagaaaacgtttatttgctggaagaaactaacaggaatcttttttgctttgcttttgtaagtaaaaacaagtgaaaggaaaagaataggctgtatgtttatagtcaccaaaaagactgcaaaaatgtgacagaaagaagagaataaggtctttaaatatcttttcaaattaaagagtagactggatctatgaataccaaacatcagcggcatgcaatttacccatgtcataaacctgcacatacaccccctgaacctaaaagttgaaaaacaaatgaagtataataattatttatagcatttaaatgatgaccaaatcaaagatgaattatgaattcagttagttcaatcataagacaagaaaaaaaatgtacatctaacaattagcaatcacccgataagatacagaaaaaataattaactttttatgactatttttatttcaaataagtgactgaaaagaaataaatttcagtgggatttttccagtaacagttttatgtcactaaaacaaagacaaattgcaatagaactttcactgtagattttaaataagagtaaaatcattccactttggtttcattaaggccaaatgtagacaaaggaaataagaacatgatcacattttattctcatctgtttcttacttctatgtaaggtttaacttacaaaagtgttatcatttcaaagatacgatttctggtatgtatttgaaaggcaaagtaagaacaaggtggtacattatccagaagcattattttttcttattctttttatttattttgcatttttcttaataaaagaagaatgaaaatgcaggaaaaaatttcctctctacataatttaaaaacatctttcaaattatactttagagttcatttgcaaaattatgaacaatgttttacatgcagtttttcacatgctgaaaacatcagtttttacttaatctccttatgctgtttctttcttccttcctgtagataaaagcctaaagtgggtttgcatggattacagcttttctcattctcctttcatcatagctcattgttttgcataatgtgcataaaatacatataatatatccaatccattttagcctcagatcagagcaagtattgaacttttacaagttttataaaatttgcaaatttcactcagcaagacgaaaaaatacatacattctaatgacttttaatttggtaaataaatgttgttaaaattaatgcatgcacacacacacacatacacatacattaggtgtttgttcattaagacctaaaatttgccatttccacactatattattcacacagaaagggcatcaagcacaatgtaccataaagctgtttaacttctccttaattgggaaaagtaaactcaaaatatctaaaaggcaactttatgacagaatagaaatctgctataaaagcaacattttcatgagtatttaaaattatctctacattttaatagctatttggacaggaatgtgtaaccaaagagaaaacttagaaaaaggcagcatacaacattgaatcagtgatgaattaattgttggcagcaactacaaccatttttgtattgttttgcatttaaaaatgttttaacctgtgtacaaagtgtaaactaataaatactaattgatttaaatacctgattcaatgtttcttaagcttgagacacatattaaaggaaaaattatgctatgtctcacaatattgcattatttccagaatgtcatttaaattagaatatacataaaacatggcattaatcgtatatatttatagtttttatagaaccatatgactggaacaagattttaatatacttttcatagaactacaaaactaatgaagtttaaaataatagtattattatgtggtccatagcattgttttctgaatgaaaaaccatcactcacaatataactatgatattcatcatcctagtgcaggttctgttgagctcatcttgtctgtactgcatttttttccttataatgactgactcaattttctcacacttttgggtattcaaactactgtgaagcctttattcatccattatggtatgatgtcaggtggatataacttggctccacttttagatatacatattaaccttgcccaaattatttcctattaacttctaatgatgaaagtaacaccactaggcagcaatatgatggtaagaagaatgtgtctgtaactcataatgttctggatcagcattagatcatatatttacaatccaaataatcaggaaatatttttttagacatttataaatattaaaatataaaatttagattgttactgtggagaatttttagacaccaagtttatgatcataggcttgcatttaaaaaatagtaccaaaattatacgtgctgtgacagttagttgctacctaaagttaagcagtaccaagctgtgaagagttaatttttaagattaacattaatttggagttctaatatgagatcaattgccattgaaaaattgagaaaatataacaaagatatgattaatacctaaaactccaaagcacagggaaattcaaatattttaggaagataaatctgttttcaatgcagcaaaagcagcatgtacccgtgtccaaaagttgtttatttatttggcatagtcagctattatattgtataatgttaggctaagaaagggtttccaaaggaggattcctttctgtctccctgtttcggtctctgacaatgtcaaagtcataattgttttaatttcatacgatcttgacacgtgtgtgtgtgtgtgtgtgttagatgtaacattaagggaagagctttagtaattataactttaattgttatggctgattttttagaagaatatttccaaatataaaacatatatagaaattcataattatatggaaacataatttttatgcatatttcaaaactgatgtatgaaagtcatttagctaattaatgagtcagaatctcttcctacatttgcattgttacttgtcactgtatgactttagaaataaagccacctcctagtactatttatgagaacagatggaatatgaagagtccaaaaagaaatgattctttactggatattttcaataactatgtaaatggcttaagctttgtatttattggtgtaaatcaattaattccaattgtagctagtgttagctatattccactacatgttttgggtaaattatatgctataaaatagttgaaaatcaaaaatgtaagaatttgatagctaaagtctcacaaaattttaaaaattaagtatgacctgggaggaagaatactgggcagtctttaggaatgccctaatgtcgaggatcttaagtaatagtagggaatgtaaaaacattgagttccgttagcagatgaaaaaaatgctcaaatgcatattggataattttgcctaaatgtggctttaatacatggttgtaaatttgctattgcagatgtaactagatcacatgctagacctgatcaaaatacagtaaatgttgtagctacctttttttatttacggtttcaaattcaatggcttgagtttcaggaataaatattccagtgaatatcattgttcatagttgatgtccaaggactatactaaatttcctcttcttcatctgttttattacataagttgaaattttaagaaaatgttttacaaatgtctttatgaacaattatttttccatctgtttttttttgtttgttttgtggtaagaatatttaacatgagatatactctcttagcaaatttttaagcatacagcccagcattttaaagcacacaacacaatatttttaaccctaagcacaatgtttcaggatctctagaacttatttattttgcataacaaaaactttattcccattgaacagcagctccccattttttccttgccccaggccctggttaatcaaccattctactctctgtttctacaagtttgactgttttggatacctaatataagtgaaatcataaaatatttgttgttctgtgatgtgcttatttcacttagcataatgtcctcaaaagttcatccatcttgtaacatatggcagctatcccacttcaggctatttatgcaaaggaattgaaattaggatctcaaagagaatttttttaccttcatgtccattgcagcattattcataatagcctagctgtggaaacaatttaaatgtctgatatggtttggctctatgtcctcactaaaatctcatattgaattgtaattcccaacgttggtgaggggcttggtgggaggtgactgaatcatgggggcagacttctctcttgctatcatgatagagttttcacaagatctggttgtttgaaagtgtggagcacctcccccttctctcactctctcttctgcccaccatgtgaagatgtgcctacttctcctttgccttctgccatgatggtaagtttcctgtggcctccccagaagcagaagcctgaccagagccaattaaacttcttgtctttataaattccccagtctctggtatgtcttcatagtagtatgagaatggactaatacagtgttcatcaacaaatgaatttaaaaatgtggcatatacatacatattcagcttttaaaaaggagaaaatcctgccatatgtggccattgtttttattccttgaaatgggacaattcaaataatcaattcccattactatgattttctgaaaaaaatcacaggatacataattgagataaagtcttctattataccccaccaaccacccacacacaggcacactgcccaatgctaagcatttattcttttctgtatcttggacatttatactacagggatagaaatagacattaccagccaggtgcagtggctcatggctgtaatcccagcactttggcaggccgaggcaggtggattacctgaggtcaggagctcgagactagcctgtccaacatggtgaaaccctgcctctaccaaaaattcaaaaattagctgggcatggtggcagatgtttgtaatcctagctactcataaggctgaggcagaagaatcgctagaaccagggaggtggaggttgcagtgagctgagatcacatcattgcactccagcatgggtaacaagagcaaaactccgtctcaaaaaaaaaaaaaagaagtagacattgccttttattttgaaattatacatgatatttgtgtttcctagaagtagataaagcaagcaaatatcattgaagaaacgcaagatgaagtgggtggttggttgaaaatagagaggaagtagatatcccgagtatgagagaaggaacaccattcttggttggacaaatatctataattgtttttagtaggattattttatgtttctacatatcatgccacatttttatgcagtatcaaattttgaggactgctattgggtacttcatggaattgaattctgaggaccaaagtcttgaacttcttcatgattaatctctgcatccaggattggcatcaaactttatggcatttcactctcaagggaccgtgtaaacataggtgaaatacctggaatgaccagaatattgtttcctaattgttcttgatttaatacaatttttgacacttttaatgaacttcagtgggcaggtaaactcaatggctggattttagtatcccctaatgagctgtgacagaattttagattagattcaatttgatttggagaaaaataaacacagcggtacttttttcaaacatatacatgctcagatctgctatatgtgaggacctcatccagatgtgtactgagggtttatgcattgtagaatgatagcaatctacagaaatggagagagatgcttttgagacaagagtgttgacctagttgcaggacttgcgtacgtggatgagtctacactgagaagtaactactgatttgaagtacagcactaacgtatgctgaaactaagttgattaaaaactgctcacgcatgaaacaaaataaaaacgcgtacatctggatgttattgaggcagtactgaaagaagacaatgcttctgaaaatccaacctatatccaacttacataattatttattcatgtttgcccaatcatagaagattatgctttttacatggaagcaaactatctctggaatcctttagtgcctcaaatttatatgtagctactgggatgggccattctttaagagacttacaggtttactgatgaaaggggttgtagaataagtagcaaggagagaaacagctgaccagttgcttttctactactacttccaggaagaaaagaccagcagtgtgttctaaaaacccattaaggggagaggatataagacagtcccacaggagtaggagacaggagttagagatttagtagggcaatcaaccacttaaaaatttttagcgtgaatcccaagttatttgatatacagttgagtttaaggctctgaaaataatggacacctgcttctaattctgccaatttttctggagaaatagcagaactacagggagaaatatcagaccgatacacacagacgctatattctgaggtatccaaacttccatatttggtcaagtactgtacgttgagccagaaagagcagaactgactttcctcaaattaataatgtggagttgaatatgaacatttctattacaatgaagagttgttcttttgcatatcctagacaccgtttaagcctcaggtatttttgtgtgacacaaagatgtgtgagagataccaaaacatattactgaagttcaattttacaccattcttgtaatttggggcttagggattatttagagaaattaagcaatgtagaatatttttctccggcgggtggtgaagggaaactcacatcagttatattttcattgtgagtgcttcccatggtagtcacaaacacatccatttctccagtatactgcggaatttcaaacaaggagaaaaatctgatgaagttcagctcctgcctagcaaattctaatcgggttaatcaatatcagccagctctaccttcaaaataacaaatgttgtgacatatgctatgcagagtttggcagcaaacaattgaccaagaaaagaagtaatgggatcagatgtgaggaaagagaaaaataagtatgatagcaagaatacccgtactctttaagaggtaaggcagaagaattaaacatttaaggcacagcagggattgacaaagaaaaaaaaaattgaccttcagggaaggttcccagttcggagatgtgagattattgttaacagacactttatgcctgaacagtttgttatctaaatacatttccatggacccatacgtttgaaattaaatgggtgaattttcagagaaatccttagttttcccagcattgatgtcttcccaaagcatattatattgtgttttaaaataaatgattaaaagggtatatttaacacctcatatattatatctcacctgattgaccaattgccaaataaagcttatctccattttttctgagtttaggattatacttataaaataaaggttactataaaaatttggttttttaaattatactttaagttttagggtacatgtgcacaatgtaaaaatatgtttttatttcccgtaaatacttttaataagacatttaaaataggttaaaactacagtgcctggataaaagtgcttgaatctcctaatcctccatgtaaatcttaaataagcaatatacccgtgagatctctaaatccacaaatgcaaattgtctatttatgttgccaacaagccagatgacattcagagcttcctcaatacccatgaaacacctgcttgctccaattattagattttcaaatgctatttaatatctcatatattacataaattttatggataaacctagatatatatacatatattaaaaccattattttcttcattatattctttataatcgtattaatataaagtaacaaataaatattaagtaacaaattcagaagcagatcactttttttctaaaggaatcagagagaaattttgtcacacctacatatgcctgcatagtgtttaacttggaatgatacaaaagtctttaattcatcaattacactattaattttacatattctaaaattacatactcatatctccctcaagattttcaaggttccttatcttctttttcataaagatgttaaaacataattaatggcttggtgaataattttcatccatacagatataagaagcttaggagatatcaaaaaatatgtttaaaaataagctatttatggatctacagagtccttcccatatgttttaagttactttaagcttttaattcttgaaatgtgattagattaatctaaataaagataaaaagaaagcaagcacatgcgacggatgccatgttatccatgtagttctgtgcatattaattctaaaattgactatgttcctaggcctacagacctggtttgaagattcattctgcctgtttctttgtttctggttttttttttttttttttttgcatcattagcttaaaaaacattgcattaataactcctggtgagttgaactcattgtctccagtccaagtggaggagatccttagtctccttccttccataactctcttcccacttgaactggagatgatgattattgcataaatgctcaggatatttttgcatttgaacccacataattaccccagcctaagtaaagtagtcataatagacttttcattctactcccacatttaatcaatagcagaatattttatttttaccttccaaattctctggatcctaccctgtcttctcccattatactgctttagctggactcacattcccctcaccttgatcattgcagtacttggcactttgtctctttaaccagataaacctctcccaaaaattatttttctaaaatacaaatttgaccatttaactccctcacttacaaacttggaaagttacaaacttcaaaaggaccctctctcattgtttatagaatcagtttcatcagttcagtaagcattttttacaagtctccatcctaccccacaaatactattttgttttacctctactacttttttttaatttaaatgatggttccttgtaatccatcaaatctcatctttctttacttccatttttttcttatgctttgataccaaatatatcaatgtgataagctcatcctttgagattgaggacaaagcatacctcctgttgaagccttacacaatctctcaaaatatagtaggtttaatctttattttttcactgaaactttatgtacttgtagtgtgttgttcttatatactctattccatttgtttacaagtttcactaaaatattgtaagcttattcatttaagacatttatctaatttattcatatgcctttagcatatgttaggttgaaagcatctaacaaatattcattaagtaaatagttaatttaaaaaattgatctatgtagagtgactaggccatatctgatgcaatctatacctgtgctattctgaatatatgatatatattatatctatctataatatatataagtacatatataattaatacatttatacctatgtctgtatctctctatctcaaataaaaaatgttacaggagccaaaagaaaacatttatagttttaaaatttttcacatatttaagtatctgaatatctacataaataaagtagaattggacagtttaatctgcagtttctttagagtaagcaaagtgaatgtctatttctacagaaatggaaaatactaataacattctctgactgtctttctttgtctctctataatatacatgcccacacacaaatatacaaatacattgatctttcaagttaaaaaactcacaatataatccttttatcttccaatatatcactatcaggtttatagttctgctgaactgaaaaattttgggagaagcttagaaaacttttatggataaagagaaatcaaaatcatgcttttaaaattggaaggcaagaagaattttcagctgtataaattggcctacaaaaggtattgctaaagaaataaagtatgctgcaaatgtacagatgccctgacctgtggagatacagtaattccactgacaataagcatcatgagcaattatttttatttccttactgcccaatgtctttgatgaaaaagtactatcaacctagactacagaatgtggcattaaagtttaattctcttcaatcaggtaggcagagatcaaattctgacactggcttttattgtggaagagttagaactttctgaaaatctcttttaaaccactgaagcaaaccaaaaatgttataagagccaaaagaaaacatatgcagttttttttcacatattcaaatatctccacacctacataaggaaagtataaccagagagtttaatctaatttttttttccaaaggaagctttttttttttttaaagtttagtcttgctgcttatttaactctttagattcctgtcttgtttttgcattatcacagttgtataagcaggctttcctataaattaaaacattaacagcagaaaagtaaaataccatataattccatacactgacattagcttttttacgtttttacttaaaaaataaaaataatcatattgatagtttttttgttttcaatgtgaatatgacttatgaagtgtagctaaaatttgaaaatgtagctgcaagcatgggatatatttttgaaaataatgaacaaaaggacctgaattttgaacattttttcacaattgcacgtcagattaatctgctataatagaagcacacattaagcacaataaagtatttatcagtgttcaaaattactattttttacgcccctctcatctgaatgaactgtctttctaaataatgagaagtttatctcattgtttcttttaactaattctacttcaatttttataactttatagttctgggaaatacatccttactttcaaaagggcatcacttccagaaaacatctgaatgtttaaaaaaaaatcatcattttagggccagtcataagtttaaaagactgaaaagtagcacatgtaaatttgtaaaagtcaaatgtaatttttttatataggacaagcattaagcactaaaattgatttaacgaagatacacttttgaagaaaacataagtgtttatatttttctcaccactgataactcaaatacagattaaaaaccatatcattctaagaattgctaaactatatacacagaaaaactgtatttttatcaattcattcaaataatatactatacagattataaaaggtgtggaatgtttcacatccaaagttacttacatataatttaacattttttttgtatccactttttaaaagaagaaaaagctgctgaaattgttatatactctgggttgatgataactgactctgtaaatttctacctttgttgatgaattgaacattctatagctatttagccattatgtgtttttgaatcctttttaatgtattttattaaaattcttttatttaaaatgaaaaggctaatagatgtgtcagaattatatcaaagaaagaaaaaagtacaaagaaaagacaaaatcataccataattttattctaattatttcataatcacctatgacataaattggcaagccaggcttcatgaggagaaagaaggaagtggacatggtagaaagaaatgtaccatacccgtcttaactagtcgctgaggagagattctccaaacaagtttatctttgccaatctatctttgcctatctcatgaagtcccctgccacactctgattaggttggctgtagaccatgctatttaataaatggggatactaatttgttataagagagttataacaaatttctttttctttttttttcttttttttttttttttttgagacggagtctcactctgtcgcccagcctggagtgcagtagcgcgatcttggctcactgcaagctcctcctcccaggttcacgccattctcctgcctcagcctcctgagtagctgggactacaggcgcccaccaccatgcccggctaatattttttatttttagtagagatgagatttcacctctgtggctaacacctctgtgttagccaggatggtctctaactcctgacctcatgatccatccgcctcggcttccctaaagtgctgggattacaggagtgagccaccacgtccggccgagttataacaaatttctgagtttcataaacagtaactaaacaaggtttttgagcgtgtaattctttatgttccagtacctttgctctttcttgttaaccttctcttatcaaatgaagcagacctataaataaatactgtaagatggctaacaaactgccaccaaaataaaaacaaaataaacttaattttatattatcctaatttataaaattcttttaaattgatacttcttcattcatacttcatattttcacactactaatttacctaaagtgttagtgcaaaattaaaatatgcagataagttatttttaacatcatcccttctctgttattctccattaattaataacaaactatctcaagatgaagtttaccagtgagttccctggttaaaatcagttatttgccaatttgcttcatgtaaaaagattttatgtatcatctatctatgtgtctaatcatctatcatttatcatctatctctttgtgaacatctgctgagactagactgatttgccacaattatttggctaaactgatggcagccacaagccctctggagtggctactgtgaagacaccagctgctgtggtgaggcgggcagctccaggtgctggcacaggtgctggctccatgcaaggttacaactggaccagaggtactgcacgtagctcccactgcaggcacccacatctggacgaggggaatgcagtggttcccagaagcttggagatgccatgtggtcctcagaagcttggagaggagcttcattgatcagcagaacagctcttaggaggcccgaagtgggtagttgctttctgtaggcaggttatcccaggagacccagagtgggtagctcctttccagctctctgcagagagcaaatctggagtgggtacctccttttcataggcaggttgaccctacaagtcaaggagactcaaattgggtagctcctttccacagctggtcatccagatgtctctctgagtctggctgagtagggggactgaaggtgtgtgtgtgggggggttggtttatgggctttagaagggaggaagtctgtgctgattggccatggttgggtctggaaaaagcaccatgagttctaaatcccaaagtagactccacctggaactgacagcctggccccatgcttcacgccttccctggcttgaaggtggggcatcaatggggactcacccctttctgcccaggagcctgtctgcctcccaccatcatcaatcatgttgtccaaggcgctcaggctgttcttgtggaggggcgtctgcaggtccatagggagctaccctcagcatccccttggcctccctcttgtgtttgtcagtgcccaaaatctggagggggccagggcggcagagggctggcatgtcagcatcacccaaagcatgggcacacctggccggtcctgacagtgcctgggcttggcctcaaccttgctccaaaattggagcaggtgccaggagtggggaagagtccaggcagcaagagcaggcacttccaagactgtggggccatggggtaggctctccagggcccccagagcacagggatgcctgggttcacagccatggctgggtggctgcagctgcgcccgggagggtagggctctcacccaaccgacttggaagggggcgtggttcctgcctgctccttggagtgtaaccctggctgtgcctcacctactgcagccagtgtctttgcagtggctggtccagatgggccacacctacaatcaaaattatctggaggtatgtaatttattacaataaaattgttatttattaaaggcatcaaattttgctttgagacagccatttgatatttatcagttaaaatagtttgaactctttctctagaaaattcagtatacttggtataacttgtttagtattattaaagattaactttgataggaattaacagtaaagatagtagaactggacatcaatatttacttcttttcacactctagtaaattaaaagaagtgtgacatataacaattcacttttattcttaccaaaatttaaatggtgaaccattttttactatttatcttgccacagaaaaccaccaaactcattaaccatctggtaattatgccaaacaaactatcataaatccataattattagtgccacaactctctttaatatggttaaattgtctacttttttttccttcatttttccttttggtttcaagaaatacagaattgtaattaattagtcatgtttgatcctatggatcgtatatgcgcctctttggcttttggaatctgatgacatactaaagcaacctatgtttgataaaggtgttttaaaccgtagaaaattatttctgcttcatcaaaggaaaggaatttgaatatatctgtgtatttatattttctgtgaaatagtcacaaatatattttaatatacataaaaaattcacatatttgtgattggagactaaaactaatttgtaatttttgaatggacacaatcatcctattaaaatgtatcacatacatattttcttctgctaaaatctatttataagaacttctgaaggaaatacaggtacagctatgatttctcaattttcaaattccaactgcaattttttttgtacatagtagttttccaaaaaatatttgctgaattaagttatataataattagatgaaccatgaaattaactttttaaaattttaatcttattttgaaatcaattagttgcctaaaaaatacagcaattgccaattttcagtgtaagtattatgtgtaaatcagatactctttaatgtaaattcacttggtgaattaaacgagtagtctcattttattttctacatatggcaataaagtaaccttaattgtatccccaaatggaataaacagatgtatttttaaaattgaacttgatgctgttgagcaaacactatttgtgtttgatagaatgaaatctattatattgaatgcataggctttttctgttactcgtttaaatttttgattgaacatgtgatcactaactgtggtttaccatcacatttagtatagctgacattgattttatctagaaaataatctagatttacctttcaaaaataatttgatcataaattattgctaggtattttgaaaggcaaactataataaattctcactactcaaaatatatttttatttatttatctatggaatgacacagaaaagtagaaatcataacaggactaaacagaaaaaggtgtgtaaggtattacattcaaaatcagttccaaaagttatgcaaaagctggaactatgaaaattttaatgaattctaatttattatttaataatatttatttagtaaaattatattttagattgattcaatttgttaataatatttgaaatatctgtaagtatttcaaaaattctgatttggagaactaaagtacaaaaatacataatttttaaaaatcccaaggaaatttgaaattctagtaattttatttaaaacatgaacaaagaaaaatatttagtaagcaattataagggttgtgatagttcaggaggtcatcagaaaaagatttcattattatgagatgaaattgtaaaaaaaatcttacatgtgaatataggaaaaggcctactaatttgatggataaaatataattttaaaattatgacataattactaataagaatacattaaaaaatcaaaataggttgatgttttaaatttgaatctctccatgttgtgaagtaatagtcataaatttagagtattacatgttccatcttttatttttgaaaatataatctctatttaataaaatgtcacctaaactacagctgttaaaataccaacatcattttccaagctgtaaaactaattaacttaaagctaagttgattaatgatagttgaaaatggttattgtacaatcaatatcactaccctgtaaccatcataagttacctaacttctcttagtctttattttggagttttttatctaagcatataagaaaatagcttctgtccttcctcaatatgataccagtatggattacttatctcaaatattttttttaacaatattataggatatcgtggtccctaagaatatataatttaaaataattcacttttactgattttcctgcaatctttttaaaaagaaacttgaaaatgtcaggaatcaaacattaaagcttactaatcttttaacaaataattagtgtgaattaattatgctcagttcaaggtagaaagagtaataaagtttaagtaaatagtaagggcaagaatatgaaacacttcaaaaatatggagataacgaccaaggagaatcaagtctgggaaaaaaaaatcatataagattaaagggaaatttggagctggagggtgggaaagttgtggggatggatgaggactcggtaaggcaaaggcagagagcactatggaaaaaaaaaatgcctggaacagggtttcacatattaaaaacaaaccatctttgtgtctcagtgctttgttttataaatcatttcctaaattctgtgtaatctacagattaaaaaagttatgtataatgtctttgcttatttctgtagtcctctgctgtgtgagtctaatttgaattttagtgtaatttcaacatagcttttacaggttaataaaacttacatgcattaaaatgctattaaagtgttacacatggttaataatacttatggatttctgaaagcagtcattattacactgaacaaagtcattaatgtctttaaactttgcatcaggaaataaaatacaaaatagatgtctaactgcaagaatagtcatgatatctgactataaatatttcttctctttttaccatatatttttttcttttgtatttgatatttcaaataaaatatactgtaataaaaataaatgagcaatgcattggattctggtattgaccttcccactgattgtgacttcagctttgatgactgacagagtacaaacctccttaggcctttgccttgtcacctatataataactaggacactaaaggtaatctctgtaatttccctcagccctaaaactcaattgagtttacagctagaaatgaaatcatcaggtattatattttctgaacaaaaatattttcaattattttaaataacatatatagtttgggaatggcaaagactttgaaaatcttatctattatttgtcatgtaacttttctctacttcagatgtgcatattattaaattggcatttcttcattacgtaatataaagtcaatcacttaaatgtttggattgcctaaaacatacattactaaaaataagtttaggtgtttaaaatgtccattcacttctctataaatcacctgaagtatggttatagaatgatatgttactacacacctaacatctaagtaactgtttatctaaaagaaatactaacttattttgcttgaaatagttaacttttattttatttcagtatgcaaaacatactgcctatgtatttgtccacagtaataaggagactatatgtcagtggttcattcattttactatccagagtcacattccaaacaggcttaagtccttccttcccttccttctccctccgtccttcccttacttccttcctccctccctccttccttcctccctccttccttcctcctttcccttcttcccttcttccctttctttcccttcccttcctcccttcccttcttcccttcccttcttccctttccttcccttcccttcccttcctgtttaaataatctacctatgatcacgatatagcacactaaggatttacagtataaaacatgctttggaagaattatattttcaactggcacactggagcaaggggacactgatgtagacaatgtcatatggtagcaacatcagagtttatcacattaaattagcattttatggtaacaattcaattaggcttatagttttcattgaactttaaaacatttttatagttatataacagcaataaacataatgggtttataactagctttatatttgtatatatcaaatatataatttaactgagacaacatgagatttattttgctttgaaaggagtccatatataaatcaacttataaatttacaaatctgttgcatagaaaataaattcctaacaggttcagtgtctctaaatgtgcctgagaacgttagacaagaccactgaactcaaagtgtaaaaaattatatctaatctgggtttcttggtaattttttttttctttcttcatcaaaatacaactcttctgtgttgatatctgtgctaactaccacagcaaatttatccttgccagaaaacaaagaatctacctatctttcaaaatttagttactgcatcagcaagatttttttaaatgaatactagctatcttaattatgtaccattgtcttagttctaaaataatttaaaataataaaatgttttcatgagaaaaatcagcaatgaacaaagtataaatctgatatgactctgacctggagaggtccaatactcaaaatttaatagtagaggaagatatttaaatagactcatacttgtgtagtaatttgacccttagaccctggcaaccacaacacatgtagtaaaaataggctttcatggatgttcctgtgcattaatgcttgcctctgcccagacatttaatggtgcagccttatttaaaatagtcttaaagacacagaaataattcaataaacaagagtctggcaaatagagttaggatatgaaagtggtcttcggctatatctgggtaacaaccacgaagatcaataaagccgggatataaaatgctagaaactgacacactgagtcaacttaattctgtaacaataaaaagatgagttcagctatatgaactttgaaaaaaatcaaactcttggaataaactaactactctgtaaacagaatataataatatggctttttaagtgggcgttacatttacgatgaaagaaaataatgaaaaactaaggcacattgaaaagtaaaagagattaaaatacacaaatttcagaaaaactagataaaagtttgagaagtaaataaaaatgtgagaaggaacaaaaatataaaaactgaaaaaagtgaaatacatgaaggacagagttttaagtagtgttactcacaatagcaaggatatagaatcaacctacatgcccatcaacagcagatcgataaaagaaaatgtggtacatatacaccacaccatagagtactatgcagccacaaaaaataatgaaattatgccctttgcagaaacatgagtggagctggaagccatgatcctaaatgaccaaacacaagaacagaaaaccaaacaccatacgttctccatataagtgggagctaaacattgaatacacatgatcataaaggtgggaacaacagacaatggggatcactagatgcagaatggagaaaaggagctgaagaacctcttattgggtgctgtacttacagcctgggtgatgggatttttgggatcccaagcctcagcatcaagtaatttacccctataacatacctgtgtatgtgtcctttaatctataataaatgttgaaaatgttgaaatttttaaaaaaggaagcaaaaaaattcatcaaagaaaattttttaagaagtgtgatatacaatatgtaagcaatattgctacccaaggtagactgcagaatgagtgaatcagtatcaatcatctgcataagacaaatagaataattttaaaaattcccctgacttgaagaaataaataacagaaacgtatgacaccacatattttgaataaacacttaaaactccagaaataaaaacagaagggaattaaattataagttctctatatgtcagtcattggaataaatcttttctacatggtttttaattaaataaaagtcattttaacttctgtgaaagaaatgaatcaactgaatttataacatatagcattcatgaaaaaagaccattccttggtttaattttggcaatgacggagatgaaagcaaacttgacagcacttactatatcatcctcagtcaaagataagatctaagaaatttacacttcaccaagttaaaattaatatgtgaatcttacaacacaacaaaatattttaggttggcaattaaaaaaattacaggcaattttaaagggtagcacagtctttaccttttttgtttatttgtgtaatgtcattcagcattaaatttcaattggaaaaaataattctaaaataattataagagcaagcctatggaatattctgcaggtcattaaaggctgaaatatttaataaaatagttttccttgcaagtaagacctcaggataaatacccttaaggtgcaaagttataaagttgagtaattttcccaattaaagtcaaacagaccttagcaaaatcattaacaaaccagcaacaagaatgaagacattaacttttactatgattggcataaactttgaagcaaaaatagtataaagataataacaacaaaatattttaccaggtttttaagagtgacatgattctttttgattaaatttagagaacacaaaatagaactcagaacaataagttcaattttcttctttaaatatcaaataataattttattatgattttacataaacatactatggattaacccttaacccatgaacaaatctcataatttgacttgaaaagcactaccttctatcctagaatatgagttttctttggtaagtaaactatctaaggactgtgttgatttggcaccagctctgacttctcatagtgtagcgtggagtcccagtagaaactgcacctcccaaggcattaccattgacagatcttcaggggcttttaaacacattgaatcagcaatgataattttggagatagatgactcctatttaaatacagtttgaataactttatagcagtaatgaatgcctatgcttatccctgggaaatatgccaggaaaagaagcaggcatcttcagcctgaattctactggcttcatgctgtaaaaaaaaaaaaaatcagccaagctagcctgtggataacttttccctaaaaggaatatttatacaggagcttgctatggtttaggtgtccataccaaaactcatgttggaaccttagtgcagcaatgttgggaggtggtgcctgtacacagtgaatagacctttaaaatagattaaagtctttctcatgagacgggatttgttctctcgagaaaagattagttctgggtacagtggttgtcagaaagcaagcttgcctctcctgtctggtccttcttgcattccagcttccacattcacatctctgccatcctatggtgcagcatgaaaccctcatcagaagccaaacagatgcctatgccatgctcttgggcttttcagccacttgaagcataagccaaataaacctcttttctagtctctgttattctgttatagcaacactaaatggactaagagctcttacagtgcttgatttaacaaatactaacagattgtaaaaatacacattttaggtttatgtttacttattttgataatcaatttttttattgaacaaaatgtatttccatgaattgaatcctgatttttaacactgtatccatcagaaatatacgttcaatttatgattaatgacttagtccaggcaattattaggttataaccctgagaatccttgtagcagtcattttaataattttgttttatataatttccatttgtataaaaaacatgtttactatattttatcaatctacaaaagtacgataaacagaaagtatgttcaaaacacaagatacgagaaagaaggatttaaaatacacacacacacacacacacacacacacaggtacacacacatgtctgatgcatgtgtatatcaaacaaaaatggcatgttaggcaatgtgtaataactaatatctatgtcgtaataataaataaacattgtttgcctatgctaaatgtaagttaatattcttgaacttatatgaaattagcttttatgtatgtcttactagagatacacaccaaataaaaaatacagtagataccaaaatatataagtaggcaaaacatgccctagatattgaacacagaaaatacggaagtgacagtattgtatagaaggcagaatatattagtgtcttaaaaagaaataataaaatatagaaatgataagtatactttactagtaaataactatatatcaagatatacatgataaacctgtcagtaatttaagatatatgacagaaatacagctcacaaattttaacttaacatcatcctagcacaaatgagactgaaaggaggtcaagtatgtgtgtatattttttaatacctgggttcggttattattttaaagttgaacagatagtgactaaattctcaaatgaccaatccattggatatattatataatcagaaataacaaaggaaaaaaattcatctcctaaaatgtttaaaactatacctttaaaaagtggttcaaaaatatagtgattgatagaataatttgcttttataactcaaataaaatttttataacctattaagatctcaggagataggcatagtagtaacagaaatgaatctctggctaggaattattctataaatgtgaaatattagcaaatcattcatttggtataaaatatttgagaaaaagaataaaaacccactttgagaaaggagaagagataaaaaaacaatgataaaatgagggatgatttaactgggaaagcaaaacatgggagtgatatgaatatatgatatttggaaaatataaacaatgacattttgtaattgttattttctaagttgtgcttatatatatataaggtaaaatcttacttcaaaacttagtatttacattgcagagtgcattactagtgggatgtttataagctctcctaaatatatatttacttacttgtgggtaaataaatactgacctgcagtcaaaagtatgtccaggcccatcaacacagatccctccattaagacagatgactgaattaagttcaggctcagcacaattatcaatgcttttttcacagtatgcaccagtgtatccacgtgggcaaatgcaagtaaatccatgtgctgacttctgacagaagccttcattcatacaagggattgatgtgcagtcctagattaagaaatagagaatcaaatttgattattagtataaggttgaccattttaatataattatatttttatttaaacataatctaaaaaactgatgtgcaaacttgtttgacatttccttcctctgttaattgaaatatatgtttatgacagtaagcggttttttaccttttattaccagaaagactgtcaaatattttattgctgatttaccaagaaataaaatcattattaatctttataaaaagatgtatcatgtcagagaactgcccctgcccccaataatggtgctaaagcaaatttcctctgcagataacagaattcactggcccttagtgtctaccatacctctcagttttcccaaaacagccccagttcaactctgctctcctacggtaatgattaatagtacttccattaaatttcaaaggatttctgggtttgatcacatacttagaacaaacatttcacaatgcatttatatccatgtaaaatagctaaaacatctgtaatagctgaagtttgaatccaatcataatcttttaattacctacttttccccatgcatttgtccaaatgtatgtccagcatttctgacacctgtagctgcagaagtgcaaatgtcttgtagagttagaggaatctggataatacctgttactttttaagcttaaaaatattttaaaatttctcatagttttacttacttattcaacaaatggtattttatttattgtaactacatggatgcacaaaatggtgataatatcacccacctcatatggtgtgctatgagagttaaataaaataatggcactgtgtcttaaacgtcatatgtgatcagtaaatattatctttctttcttctccactctgaaggccaagggctcagtcagcctctatttcaatcttttggcacttaatttgaacaagaaatatgtttctctgtatatttagcttctaccatatcataccatatgcttttaagtttacagtttagggtttatatatatacttacagtgtggaaaacacatgtcatagtaccacaaacatggtatgacattatttttcataatgtaaactgaaaagatttgcacccataattctgagaactaatttatggaaagttatgacatcattagtaaaactgtttattttcaagagttttacctaaagataatatcttaatgaacctaaaccaacttgaatcattttgcactctaggtcttgagttcttacattctcaaggataattccatatgcaaacataaaatacttcttcagcgttttaccttgaaaagtgacaattttctagaattattgttcattaattgacacctatgcttacaaatatttagtgactttttaaaaaagtattaacgacaaaaactcataccgacaagactattatggaagccattgcattaatatcatgtatccactggaaaattagatgatgttaaaaatcatcagagagattaattagcgtcatccacaattagaaatgaattgtgcacttcagtataatattccagtcatgcctggaacttagatagtgatcttgtacacccccaccccctacaagtgatagaactaagtatgtttttataaacaaatcctttgatatttgttccacttttgctgaaaacgtgaacttgttaagaaaaaccaagagcacatagtagactatcctgtaggtattgcagttttatttatggaatagaaatgcagaattccacagggagtggcatggaaacatgtttctcccctaactctgtttctagatatgtatagaatgatttattagaaaacattacataaactaattgaattgtatctcccatgggaaaatagggatagtttttagactgccaaaagttctgtctccagggtttcaagaatcttttactaaattaattagaaagcttaatgggaaatacaaaggcaatttctttttagaggaaatcaaattgtcatttaaagttcttgatctttcctggtttaaaaatttaaaaggatgcctttcgttttgttcatcatttatattgctttgctatattctatttaatataataaagtgctttcccaaagagttcactaaagtaatttcagaaaataaaagatataaaaggttgagtatttagagaaagagatggaagctgggaggaatcctgcagaccagggcaatctagacaacagagcttgaccccagtgatatattcattcaacgtgtactgaaaatattatgccaggaaatgtacaggagcatgaaaggaacagggcagtgatatattcattgtgaaattcttagacagggcaaagtacatactgggctagtaaatgtgacagttatctcactgactcagttagttgtgttctctctgagggatgtggtttagatccacagggttgtcctgtgatctcttaactgcctagaaaaggaaattacccaatgtcatctttatcataacatttctctcatggcatcacgttttattttttagcattggtgttttgggtagtggaatactttcctcaattaagatcttggagaaagggaaacagatacagagagaactactatttgaagagtgggaacagaacacggtacctactaagtccctaccattccctctgcaaaggcctattaaccttcacagaattccgtgaactttgtccagttctgaataaaaactgctagtgtagtccagtgtttttaaatgcgtatattcaaaatctcattaattatatgggcttttactttgcaagctgcaggattgggcaatccaaaagactgagaactttgattagacgtaactacggaatctgtagcattgtaagtgatgtggttgctgttggtagtaaaaagagtctggaaaaggaaatgcaacttctcttacccccacttgttttgctcttctgatctaggtttgggctcacttttgcatgagtcgtgataggctttccctaacttagggattcaagatttatgcaggagggcaaataatggaatagctagagaacaaatacctagagaacataatggcatttatttaaacaaaagatacatataccaataagtaataatcacattttgtcagaacaaatacgtaggaaaatatttctaataaacacacaagtatggtagggcacacacaaacaaatgagcaagagggggtcttaaaagtagtgctaattattttatgctagaaatagctagaatgaactcaaacttctgtacctaaaacacagaaagaatttttaagagcaatagacttaaaatatcttaaatatccaaaaaaggatactaattaaataaatatggtgtttccacacaatagaatattaataagaagaaagtagaacaatatatggtagtatagaatatatatataattatatataaagtagaataattttctatgattgattaagtggaaaagcaaggtactctgtgtgtgtgtaatgaatgttcccattttgcaagatcttgtttattttaaagatttgtttctaattaaaggatatcgatattctctaaaataatttgtaggaaaaagctgaccatttgttgagggagatggactccaactcaaaccctctcctggaaagcattctgatggttcaatcatttaatttcaaataaaaagaatgagaagaacttgttaaataagtcccttttaaacctgtcaaaaatcacagaacctttagagtctgtgttcaaataaatctggatacttgaaaataattttctgaatgccagaatccactatgtactaatgaaagaataacaaaaaatagaaaaatatacatgatatacatggcagacaaaatgtaaattatattaaataaaaagctcataaattacagtccacactcagagaaacacaaatacatgcactcatgtgtgcgtactcagttttttacatgcaggggatacatgtgcagccttgttacacgggtgtattgcacttgggtagtgagcatagcataaaataggtcattttttcgaaccattctcctctccctccaccctcttctagtccacagtgcctattagtcccatgtttatctccataggtgttgaatgtttagctgtcacttataagtgagaacatatggtatttgtttttctgttcctgcattaattaccttagttttatggcctccagctgcatccatgttgctgtgaaggacatgactcatttttatcactctgtagttttccatggtgtatatgtaccatattttctttatccaatccaccactgatggtcacctgtgttgattccatgtctttgctatttatacacagttttttaattctttcctttttatttagagaacttacatgagtccttgctttatgttaagtctgctcatagcaatatattcactacgagttaaagcacgaattctcttatttctacttcatctgagaaagtcacgatttttaaattctgtaattagttttttccatttcagtacataacatatatttataatttgatatcttaaaaataatactgcttccatgtaaatatacatggtgcatgagaaagatacatgccatcctcctaagtcttatcaaacttgaaagaaaaatatctgctttctatgctgccctactcactttccttttctgtttgtgtgtgcatatccagaacttaaattacatttttttcactagtcatggcatatgttctctccccaggcatgcatttgctcttctccagcattaattctaatttttaaagcttccttctaattgtcacttggacaaaaaacaaaacaaagtgtattaggtttctctagagaaacaggacgaataggatagaagtatatgtgaaagggagtttattaaggagtactgactcacactatcacaaggtgaagtcctacaataggccgtctgcaaggtgaggagcaaggaagccagtccgagtcccaaaacctcaaaagtagggaagccgacagtgcagccttccgtctgtggctgaaggcccgaaagcccctgacaaaccactggtggaaggtccaagagtccaaaagctgaagaatttggagtcaaatgtttgagggcaggaagcacccggcatgggagaaaaatggaggccggaagactcagccagtctagttcttccacgttcttctggctgctttattctagctgagctggcagctgattagattgtacccactcaaacccactcaaattgagagtgggtctgtctttcccagttcactgactcaaatattaatctcctttggcaatactctcacagacacacccaggaataatattttgcatccttcagtccaatgaagttgacactcaatattaaccatcacagcaattttgcttgtcttgctgcccatccagccctaacataaactatattatttccactcctaaggaggttcacatgtaacaccttgccctatattgacccgagtgctcttttcagttagtactgcctatctttctccatttttcttgcctctttagccttgaaaaacagttcatgaatctcctgcagagtgtgttatctaagcattgcaccatagagaaagctaaaataaatagggcagctagtaagtaagatagagagagatgtagatcactttccatgtggagctggtcaggtaggaaatatatctaatgattattatatctcaatttcttatagacattcaatatctaagatttacagaatgaatgagcaaaattacatatagagtacacttaatgtattagtgaaacatgacaaaattttaaaaaatgtattaaactataacaattattctagatagtactggtgcaaatgaaataaaaagtaaagaaacagaatcgtccaaaaactaacccatatatagaaatctattatatgaaaagtggagcattccaaatcaagaaagaattaacagaccctttgataaaatttcttggaaaaaatgattatacttaaaagaaaccattaagttagattcctagcttttatcaatcataatatattcactatgagttaaagcactaaaagtatcacgaattctataattgtagatgagaatataataatatatttaaaatattacagtgggaaggatttctttggagagcagcaaagcccagttaggaagaaaaaggtaaagaaaaatatgaaaatctcacaattcataagctgtataaagtaagagtgtccagactttataaaagatttgcattttttcagaacctagtagattttatctataatttaaaataagacatacaaatcaaaaagtaaagggcaagtaatcaaaaagtaaaagaactataagtaggcaaggcacaaagaactacaaatggcaaataatagcatggaaaggtgttcaatcttgatagtaacctaggaaaatataaattaaaataatgacaaattacattctcctcatgaaattagtcaacactttgcaaagagtgatttcatttaataggatctaggtaagcggtgtgctcatactctcatcaggtaagtgtggtcttcagtgtttatttggaatactttatagctattaaaaagaatgaatcaggactctttgcattttaatggaatgattcctaagatatacttctaagacaaaaaagtcactgagtataatgagtttgctcttatgttaaaataaaaatattaggaaaaaatctagaatcacataggtagaattttaagaattgctctcataatattggccatgtatgtatatatgtacgcatgcatatatacatacatatgtcaaaaatgtctatttactgatattttaatacaaaactaagaatatgatatttgtactattaagaaatatggttttagacattacttcaggcaatatttgcagtaatgcaaacaagatgtatggttcattcattctctactagggaatttatttattacatttccctttccacatcaagaataactttcactatccagaacaaaataaacacaatatcaacagataattatgctttttaaaactgtgtgtcagaaaatgtgctaattgttttacatgcattatctcatttaattcttgcaataacctgaggtagttactgtgattatttttattgaatagtcaaaacataatttcaaaataaatgtaaattgagaacacacagtaggtaagtagcaatatagagtttccatcttggttctccgtgaatgcatttaactactccatcacccctctctggaagggccacttactgaatagttactgtgtttcatgtacattctcacacatgaccctgtgatgtcagaactagtatagctatgttttactgacgagggagagagacacaaagaatgtaataaaatacccatggtttcacaatgacaaaggcttttagtttgtatgcttcctccctttaccatgttattgtcaatcaaaaatgatttggaagaactccccagtattccaaaaggctcacaagattctcatccaccaagaacggtcacaattctcagtcgaccaacatttttcaacaaatgaggcatcctatataaaataccatatgtcaatcacaccacatgagactcctgaagattgaaagacatatcctgagaatattaaaggtgttgcccacgtcttgatatatgcatccagtatttatattctccttgtgatatctgaattaattgaatcctatgtcatccctacagatccacagatacctctgtctcctaagaccagggaggacgaggcagatggtaaaatttaagccatctgagcaactgttgataatggatacttctaggatttagtttggtggggcggtcggcgggagggaggagaatcgtggaattttctaacaacaagagacaaagaaagaaaaggtgggggaaaaaaagccatgatttgtagttttgtttggagcagccaaagaattacacagaggaaagatgagagaacagttaaatcatcaacaactgtggaagaaatgactctgaaacctacagcaagcaatttgatttttcttttaaattaaatttttgtcatataacttgaataaaattataagacttacattaattttgatcttacattgtgtgctagtcccatctgcatcacatgaacatggatattcattaataagttctgtgcacctgaaacacagaattagaattacattttcaaataagtagatgttaaagcataacttcaagggagtttcaccatttaaacttttctttcctagttcaggtgaaaaaagcactcccatgagcaatacaaagcagagtttattcctgggtttcttatccttgaaggtgactggactgaaaaaacggatcaattttcatttttgccattttccccatggcaatgaaaagaatgaacagttttaaaagataaaaagtatgtctagggcttatgtgagaaactgaagttagctatggccagcctgcattgcaatgagctgccaaccttctttctctcttccctgcttacaaagtaggtggcaggattataaaagaaaactaacgtggaagcaagcagcatgatgcatctgtgatgcattcttctttgccacctgcatcttctagaaataccttcactctagatgtgtattaaccaatattttatccatgatcagagcagttattatacagattcatagagtcataaaatacttttcatacacatagggctgaaagaaccagtttacttaggaacattttaaatactgtgtggtattatctctccatagagcaaataatagaatgtctcatcatcttacctgctagttctattaccatgagcagttacctttaagtatattaaagtctaattaatccacatttatagaaaattactttatgctaatgaacagaaataaaagaagggcagagataatgtatcagtacattgcattagctaaaactggcagcatctgtcatcttaaatgtacttagctcttgttttatgaaagagcataattaaaattatctttatcaactttcccttgatgttaagtcttaaatattgtgagttaaatatactttcataaagctaataataaaaaaaatagctaccttccatgtagacaaggatttgaaaggcaatcattggcgtttgtttcacagtgtgttccaaaaaacccactcttgcagtcacaggtataatgattgatgccatcgatacaaactccatcatggagacagggctctgataggcattcatctagatttatttcacagttgatgcctgtgttggaacagacaaggcaaaacatgaaaccatttaaatacaaaactcttaaaagtttgttcattatggtaaacatcaccaagaaatgaagacctctctctataatgataacttggtatttggtagcaaaagaaaatatatttcaaggttaaatatatttaggtctatgaatgttcagattactaatttaatgtgaatgacaaaaacaaagcacaagcttaatctactgaggagattgtttttagtgtgatgtttgttgagaatattagtgaagtaatgaattatatcaagttgtcactgtgaatactaattcataattttttttgtaatggtctttgagagtcaaacgtttattacctacaagaattaagaatgagtttgaagttttctaaatttggctttagtgagtctattaatgggctccctgagatttctaaatgaaatctaactttggctaaatacctgggattttcaaaggccaagtagcgaatattttttaagcacctaccaagaaccacctctatgctcaactagaggtaccaagccaaaaaataaacttcctgttcacacaaaaacgtttttagggaggtaatcatttacagatagaaaacaccgagatgataacataagcagagcttaatggaaagcaagattgtgtttcgtatgtttgaaatatctggaaagagcacagaaccattgtagaattgttagaataatttctttgcccattacatccattactagcaagcatctactaataaaaactagcattgactgagcacttataggtgtgccctgcccttaaggcttcctgcacattatcttagctaatgctcatcaaaccgataggcagatctcattaaccttaactcactggtgagtattcagagtgtaagtgaaacttccaggtcacacaggccataacagcaaacaagaatttaaatcatgtttcctctgacttgtgcttctgatcattactttaaattacctaccttgcagctactctaatatgtgcataagttgctatgctgagtaataccgtggataccaattggaaaacatggttcttgtagccaatacataatacctagttgtgaataaagataagtaataagcttattacagtgaagaagacaataatgaaaatagctgacatgtgaggctcttactatgtgccaggtacactcaatttcagaggttcatgacatagttttatttcccactcactctccatgactagagtgagttacagatcctctttacattatcttcactctgagaccaatgttaatgaagcatactctacctgggatattgacatctgtgtttaagaggaaaaaagacacttccctttcatgctgggcttggtcatatgacataaaatacaggtggctcttaagtctttcacctacaaatcaagttatacgactaagtccaacagaaatggaatgggaaagaatgtttctcccacaggaaagggcacatatttgtaacaataaaattgagtacaagcataatcaatcaagcttctcacttgtaaatgagtgttacttattggtacatcatacgtttattgggatgatagagtataggcatgcatcaaaaacaacctagccaaggtctgatacatgtttaacattttattactttcaggttcttgataaaaatatcacaaacacattatatttgattagtgatttgggtggttccaaagacaccaccattctaactaggaagataagtgaaaagtctccgtatcactatgtagaatgctggcagagtcagtgctgaaattttcagttaaaaaaagatagatggtcaatttataacaaaagtgtgggggcagggacagaaagtgttaaaagagtttgggacaggatgcatccagcaatgttgggagatgaggagatttgacaaaagacacttcactctgtttttgaaatgttctctccataaaaggcaaacatgtctcagtttagctagagacagcatcatcaagattatcttaggatctttttttcctaatgttttattcattaattaaaattgtggttataatttgactttctaagtagcctccaaagaggataagaatggaataactagccaatgtgagcattttggtctctataaaccattctcatttttaacattatagtccttcagattcacacatatcaaagtcccttttacctttctaacttcatcttattttaatctcacccttgactagtctactttacttacattgacctccttatattttctcaaaagttttaggcatgctgttcctaaaagacctttgtacttttattccctttctaaaaaatctcttccaaatatttcacagtttacatcttcttcaggtttttactcaaatgtcactatctcaatgaggactattcaaccacacaatacaaaattgcattctcgtcttaatccgcaattgccattatcctgttttatgtttccctcctgtaacaagtaatctccttgtagcattccataagatgtattcatcttttttttctttttctctctatttctccatgacaagcttagcttcataaaggcatagattttgtctgtctcattcaaactgcatacattcaaatatttgttaaaaaataaatccttgtcatatacgtgtgtgtgggtttatgtgtgcatgtttttgtattttgttttacagatatctgttattttctcagaaatcccagcctcttcccaaccacgaacaaaacagttcttgagaatctggggaaactgttagtccttgcgaaggtgagagtcagaatccaatgaggcgatggtgatgcctctgaggtgcataactaaaagagttgtctgtgcagccaaggggaaatatttaatgggacctctgctttttcccaccttcaaacaaagacatgttcatgtgtgaaaaaagacacacagttgtggagggtcttggactttggttcacaatgatctcccacaaataattaccaacctattcaaactctaagttattcatctgtaaactatgaatcaaaatttctctactgtagcatagtagagagatattcataaagtgcacatatatatatatatatataaatacatatgctccctgattattataacaacaagattgtttatcttcataggataacaatgctttgacatagcacatctaaaagaaataatagtatttattagacatgatcaaagccttggctaaagtctcagtctcagttttttgcctacattgccttatataccaggtatttcctactggtcattaatttatctaatgcatatttatgtgtcaatcagagttctagactccttgcatagttcccttgacctggcatgcatcactgccacctcaatcacagcatagcagatgattttcacaaaatctaatgatttcattatggacttcatttgacaaaagaagaaccatgttctttctttttgttatgtctaacatattgttctttccacctaccctcctgcctgctttggagctacagcaatagtttatgtttgaaataattttcagcttgtggttctaaagttttttatttcattcataatgcaggcaattccttttttaagcagattggaaggttacctgtgatatttgagtttttttcctatgatcccacttatttaaaaatcctctttactagtccgcctcaacatctgcctccagattgaatattttcacataggaaattacacaatccttttagaatcaagccattaaagttcataaactgataggtttgatcagcaaaacattttcgtgcatcaacaatattataatagaaattatatatattcctattatataaatacatgattttatgtatatatatatatatatatatctgtcaatcagctgtcttttttcagactgtgtttttttttcttactttctcttcattccctttttacccaacttcttcccatttgtcagcgttacatgttttgacaagtttttcaaaatcactttcctgattcttaatttttttcatttcacatatgagaacctcaaaacatactttatgaactctccattgtccccagaaataaatgtagtctccctagcctaaaaccaaattctctgttccaatctttcctttcttgtcgctgctctgatattatcaaatactctcatctcctggtttataaacctgattgaataatacaatcaaccgtggagtttttaaaaatacaaaatcccaaatctgaatctctgagaaataggactgacaagctatatttttaaaaatctctctagatgatggtaaatcatagctaaggaccgctgctttttatcaaactggcttaaaattaaacattctcaatattttctcatatccatgttagctcctgatagttctgcctgaaatgtcatttccacatctctgtttgcagcctgtttttttatttgaggtcttacaaaattctagttaattttaaatattccttttgatatctcccattgcatatcagctaatatcatttatcagagtctctttagggtttatttatttgaattactgtcttatcttccaaactttatcactacttatttgagctcagggatcatacctatttacttttacttcatgaaaatgccaaatacaaaattttcatgtagtaaatgatcaaaatagtcagcttaactactactgaacacatctaaattgtgataacattttgaaaatgactaaaatttacataatagcatgatatttacaaaggacataatcaagttaatacaggcatacaataatttatggacttaagaatcagtgattttaaaaattcaaattcatatttctaaccattttgaattacaaaattaaaaaagtcataagagctccaaaagcaaaatgagagttttgtaaacgtttcttattatgaacaatatttaaattaaaaacaattttaactatcatgtaaaagatttccagataggcagtccagcaaatgctattctatgaggaataatctaggcaaacatgcagccatggtgtttaaaggtgtgtcaatcaaaaattatgaaatgtaaaaaaaatccagaaacaacaaaaaatggatggaataagaataaagttgacagaaaggttgaaattatcagagaaggaatttaaaataatgatttagaacatgactgatatgttaaaaaatatatcataaaaggtggatagatgactgaatctatgaggaatatcaaaagagatggaaactataaaaatattcaaatttcaatgctaggaaaataatacaagatgaagaattaatttaatgagcttatcagtggactggacataggaaagaaccaatgaacttgaagataagcaagtataaattaatcaaaaggaaacacctggaggtaaaaagagtaagaaaacagaaaagagcttctaagacatatagaataatatcaaagtttctaactgacttgcaactggaatccctaaagtaaaagggagagataatatgataggagaaatatgtaaagagataacggacatggatttgactaaattgatggaactctgtagcagtttcaggcagtatacaagctattttgctgtttggagcatatatcttagaagactctatggtattaaagatatatgtagtggaaaatatgatgcatagattttatagtagtgccagaggaagaatcatagactgaggctctggaccaaaactaaaatatatgtagcagagaattatcctgaaattgagaaatggcttctggcatgtctgggtagttgtagagatgaaacacctgaccatgggacatcaagtatccatgtggacagaactgccaatgcatttggcaagaccagtggcaatctacagtaggtagtatattgggaattgtgtatgagtatgccagagatcacagatagttgcactcctaagttatgtacttctttcgcaacagaagctcatcctaagttcatactgtttctgtctgggccctccctggtggccatctgaaggaaaaataaaaaaagtctgaggttggttcatggatgggttgacttggtatatgggtataaactggaaatggattgctgcttccttaaagccttattaagaggttacccaagaaggtaaagcaaaagggacatccttcggatgggcagatcttcagtcccatgatgtggtcataatctttgggtggaaatagcctaagagaagaatatgcatggagttataggtagtggcaaatgacatggctggactggaaggcaaaatataagactatctgggtcagggaaatatgagaaagaagcatatattggactgataggagtgggcatgaagtgtgaagttctctgcaatgcatgttaatgcagaagaggcattaaatagccataaagaaataactcagccagttaacatctgtccttctctggcatcagccaccacaatggtggtacaacaggcatgaatagagtagctagagtggcaaatatggaggcctgtgcatggacccaatgtatgggctcctctgtcccaagaattagttaggtactgcttccctcagatatccaatcttccaggaacagagaccatagccactacacacttaatggtcagcctttcttgcttctcctgccaatagatgtttggccagaataactactcaagggcttatgtagtgttgatccatcaatatgagagctctcataatatctcactggaccaaggaagccactttacaacaaagcatagtagcaatcagataacgatagatctgttggtttcatgatgtagcacaccatccaaaaactactaggtgtaactgaggtgccagttcggagatgaaagcttttggggatggaacactaaattatagaatgcggtatgcactctatatcaataatcattatatgatgctttgttcccaataggtataatatatggaattgggaaccagggggtaaaagtgagtgaaccgatgtgccatccttctttgtgaacaattgggaaatttgtgctttgcattcctgaaaatataggttccaggaatctagaggcactgattaccaggggagggacccttgcgctagagaataccactagaatccctttttgaaatgtatggttgttgtaggctctttgtgctaagaaactatcagtcaaggaaagaagttccttattgtgatatggactgaaatgtttgtgttccccgcaaattcacatgttgaaatcctaacccctaaagtgatgattaggtcataagggcagagccctcatcaatggaattagtgcccttataaaataggcccaagggaaccttccaccatgtgaggacatggctagaaggcacaatctaagtaccagaaaatgactttcactggacatcaaatctgctgccaccttgatcttggacttcttatcctctagacctataagaaataaatttctgttatttataagctacccagtctacgggattttgtgatagaagctcaaatggactaagatacaagggtaagtgatgctgataatggggaggggggaagtaggacactgttataaagtagggacaaggataaaaatatgtgacattaaggtgatctactgagcagagtcttcattgtcattcatgaacaaacaaaaaagtcatagccttactaggagattaactgtcaggcatgagtttctagattaattcaccaggtaatccagtaggccagcatattttctagccaaggatgagggtaatataatttgcacaggagaggaggaagagaagtatcagatgcagtaccaagatcaactttggtgacagaaattggagttcttcccagtaatccctgaaagtgatcttgtctatttacccaggaagagacaaattataattttgggtatctgtttccagattaggtgtacttattttagaaagcaggtagatctgagcagcacaaagggttgactataatagataaagtaatgagcattccaggtccccattcagaacagcaacactcaattccacaaatagaggagtttcctaccaagttctaagtgcaattcttccccaggaattgaattttgcttggccaaaggggtctgccttgcccaagtttgggcctcccctctgctgtgcaatgagtgaaggcgactcagtatgggtcaactatgaaggggccatccccacttcatagttcctggagggatcaactgaggcttctgttataactacatcttagctcaacatcttcctttcccagtcctacttctctttcccctcgcaggcattgctgttgaaagtagtcactgataactcacctacatgtaaattgcagtctctttcttgggaagcctaacctatgaaaaagtttcctggaaattaatcttttccataggaatgcttttaaatttttttgtcaaaaaacttaggaaaaaatgttgaaagtgtatgaagtagttactaggaaaatgtatatcattaataaaaatattggcggtatatatcaaatactggattaaaccagcatagatttagcatttgattaacaatcatttgctaatattttcattgtttggaaagaatttattagaatattatatctgttttcagaagctctccaaggaacttttactgatgctttattttcctgtctataaatatcccaggtttggacagatgcttttaaaattcattacagtagtccttagaggtttggaaaaggacaagtatcaataaatatttgatgatgaaaatgatgatgataatgatgttcatttaaatcttatttctccttatattttcctacctcttttatgaaaagaatgggggcaattcttcaatatcaggccacaattaaatgaagtcttctctctcttagactttgttaccacaagaatgcggccagttgttagaggacttcacagtttattgtaaaagttataaaaacaattactatgtcattgtaaaaaattttaaagaagacattcaaaatatccttcacaaaattgctaagacaagcaaaaacaatattctgattcatattagttactcattgtttttagatcattctaaatgagtgagtcaagaaaggtatgtgaaatgaggcgtgtgtttaattaggcaactatgttgagagctttggaaagtgagaagttgttcaaggtgaagagatgcagaatatctctaagtacaaacaggcatatgaggattgattaaaaatgaaagatattagacaatagaagtaacagtttatagatgagtcggacttctgttctaattaatacataattacttattatttgagggccctgtgtattaactctgattaacatgttaaaatattgtcaaaacttataaacttcacacattcatacgcatgtacatggctataatttatcaactaacattaatactaatacaatcaggaaattttatttcaaacaaatgattctaatccttgctaatataatgcagaaaatagctcattatttaaagtactgtttagttcctaggttctgttatgattaaaataaacactgcatgattctatctgtatgaggtatctagtcaccaaacttatagacacagatagtagaatggtggtttctagaggctaggagtgggagaaaatgcgtagttgttcaatggcataaaatttcacttatgcaagatgaataatttctagagataagctattaactatagtacctatagttaccaatatagtattgttcactttagagtattaggataggttgcatgttaaatattcttaccacaaaaaagataaataaataacacatacacacaaaaaagaatatgagaaaatttttggaggtgatgaatatgtttgttatcttgattttggtgacagtatcatggatatatgcatatgtcaaaattagtcaagatgcacatattaaatgtatgtagtgtttttggatatccattgtatctcacgaagctacaaatgaagtcttattaatcacatatacaataatgatttctacctcatagggctaatgtgagtattaaatgtgtctacacaaagttactgcaatctaagtatttcaaaggacattctttagttcaaaggacattctttagaaatgattgctctaagcttgtctaaatgagtgcctcaaatattcttatgtgcatcattgagctccaaccattagaccctgccacattccccattccaactcataagaatgagaattgagatcattaggactaattttatggcttattacatataaacattaatgcacacaactctgtttctgattatgcataccttatttcttgtacttcaataccacaatactatttcacttatatgtacatcacaatctttacatggtaaagtatttcagtaggactacactgaataggattgaaaaccagcttgccatcaaaacaattctttaaatgaataatgattttgtgaaaacattcggttttaggtaacctgtgtgtagctaggaaaacattttaattatgcttaaaatgtgaattataggacaattttgcttcagataaacaaggctgataatcagtgggatgtaccggcatgactagtgtaaaaatattgaaatgttaagtaactagccattgggtgttgctgttgctcacccttcttagcagccccaacatttcttctgtgactatgcagacttcatgagctatcaagtgaggcatagaaacatgaggttatacataggtcaaaacaatcattacataattttattattacctctgaagatacatataacaacaaaaatgtgtctcatatcagtgagctcatgtgtaaattttttgaatcaaagtagcttgtaattttttgtattttgtaacaattagaaatgaatgagtcaggctttaattgccattattagttaaaattatatttccacataaggaaagtacatgataagcactgaaatctttcttttataattaaaaaaatgtaagattgaatggcctaaaattatgttattagaagatgacaaatggaatcacttttacagaatcctggggctttgaacaaaatttgtgacattttacaatgtatgtttctcttatttctgacaactctaccaagtaactggagatcaatgaaaaattctaattttaattcttcatttgaatgggccccaaaccagggccttgatgaaatttaaggattttgtttatcctctccaggttaggcacagacacattctgacataaagactgatttaggtccaatgagtcaatcgaatgcattcaagagaaaccctttgggaaaacaaagcagacccagcagtcactaagatcaagctgtgagccagaacactcagagtggaaaataaatgttctttatcggaaccaaaaagcgatctgaaacttacaaaattttggaggtattctttaatttaaaaaaagctcatgattacaaatataaaataaggcacaatatgttagcacaaccccttctgtgtaaagaggttaaagtttaaacatattagcttcatagtaaattcatttctagttgctactatttttaatacagagctgcatgaaaaaatggaaaaaattgaaattaatataatgtctactgttctccatatggctaattccatagtttacttaagtaggaagcacactttaaagactaagtcaattttgtcatagaagtaaaaatccataattaaaaaatccagtgacctagttaatttgagatttaattttccaaaattaagaaaacatcttattggaggtgcttgctttaatccttaaatcaatagcataacattttatttattcaaagttataggcaaaggcaatggcttataagctgcacctaattcatagtttgataaaagagtattgtttctagagtggcattttaaaaatactaagtctctataatgtttaattttaaagaccaggtgaaataaaatgttaagtgataatcacaggactttctatgttgtatgttttgattaacaaacacaattcttagttgttaatttgatttatgcataaaccaacctgttaagttgatgttaaccacaggaaatagataaggctaactgatggttgtactattgagagacagtccaatatcaaataatagcaaaaataagctttgaagtaacatcttctgatttaaaatgagtggcccaatgtgtgttatgcagaaataaaaggagtttaaagatgtaaagttatagttttgtactagtaaatgtttaactggctcttggaagaaaaaaaatcaggaagcaagggcttatttataacatagtttaattcccctgatgcagtactcccatcttttttatttcaatgtcctgaaattatgtctacaaaccaacaaagtttataaaaattaatattcagctctcatgagcactattagctttctccatcacaccactggaaaggtactttcctaagtattaatttggggttgagcagagtgttagagaactagaaacatgtgcataataaggatgaggagaggcaatagagattgttgttgagggagctgttgaaatgatagaagaaagtatgtggtgtgtgtctgcatatgtgtgtgtagcagacaattcctcacaatgttatagactaacacagtcactaattagcataatgtggctgagaatttaaaaaaaacttgtggcaatattttaataccaagatgacaatacaattatttcattatcaacactcactgaatcttatgtactaggtaagcactggtgataaaagcatgacaccagacttaggtaccagttgtgtccttattttacatagcaaacatagccacaggataatatacaacctcttgaagatcaggctgttgtaaactgggttaatagatctgggtttcaacacatagagtcaattatgagaatattcactgctaaacatttgaatcaactgtgtacatattataacaaatttaaactttattctataaaaatagaatgaaacaacattgaaaactatgtgccaaggctcgagacaatgagtgcagtaacgtggtagtattatcagttcagttgtgaatcagtaagacctaaattaagatgatgatattagcaataaaaataaacgatgtataaaagacatctctacttcttttgggctaatggtcaaatgcctccctttcctccatttttattgtaaaaacatattaaaatgttttaagttgagtaaatacaagcaaatgaaaataatcgctcaaatctcataatcgtaatttttatatattacttatgttttaattttttccacatgcctccatacatacatacattggcactttctcaatgtaaaaaataattacttaaacaattataacatgtcatgttttttttcatttggtgacatggtcttcagtcatatcattttaatgattgcaaaatatatacattcttctatgaggaatacatatcatgaatatattatgatttattttatatatatatatacacactataaatatatggcaatgtattcttccatgaataatatatacagtaatctaatttcaaaataatggttatttcaacatttcaccaataaaaataactaatgaagatctttatgcatacacacacatatatttttgggggttatctctgtagacaatttatgcagggaaatatttttctaggcaaaattttcatgtcaaatgagtattttagctcactactgtttacctcactagcaggcagtaacatgcatattaaaatagtgaagcataattttaccaaaatttttttcataaaaaagataaaaattttctattgaaaatagcaatatccagtagcgatgaacatgcagtcaaatgagcacatggttacaatctcgattggtctgcaatttgtgaaaacttgccaaaatgtagaaaacggcataatttagagagcaattttagtgaaatgctgtaaataatctcttcaaatgtgataaaagacaaatataataaaaatttcacacatttctgtgaaattccacttttgaaatgtgcctaggaagatgattatttcagtggtttgaaaaaagtgagacattggaaaatatataaatgtataaactagagacacattaattatagtatagcctcatgatgaaaagtttgacagttattataaaaatgctgtggaaatttaatgaatggcatgggggatttccagaatatactgttactaaataagaattcatgtgatcaaatcctatgaactgcataaaactaataataaatccatctttaataggttatagcaataaaaaattgttattgttcactttttgtggtaggcattttgtaatctttactttttatgttttatctgcaatttccattttttatcttgtacatgtattgtttttaatgagaaaattatgttttaatgggttagactctagatgcttaaaaagcacttgatatttgacatctcttcataataaaaatcctcaataagctaggcatagaagaaacacacttcagcaaaataaaggtcatatatgacaaagccatagctaacaacatacgaaaggggggaaaattgaaatcttttcccctaagaactgaaacaagatgagaatgtccactttcaccacttctattcaaaatagtactgacagttctggtcagagcaatttggtaagagaaagaaataaaaaacatcaaaatgaaaaaagagtaagtcaaattgtcccattgtccctgttttcagatgacatatatatataatgatatgtatatgatagatatatgatatatatgatatatgatatgtatatgatagatatatgatatatatgatatatgatatgtatatgatatatatatatataggatatatatatatatgtatatcctaaagagtccaccaaaaaacttttggaatcaacatatgagtttagtatactgcaggatacaaaatcaacttaccaaaaatcagtggcatttctatatgctaatagcaaactatctgaaaaagaatagacattgaagactaggaagggtgggagagtgagaggagattgagtgataagaaattatgcaatgagaacaatatacaccattcaagtgatgactacactaaaagtctagacttcaccaccttgcaatatatgcatataacaaaactgcacttatatctcttaaatttatacaaactttaaaaaaacgaatatttttgtgtgctttatatataaccaatttgttttaaaataatcacagtgattcttacagtaatgttactatttctgcttcttttgttcaaacacattgatgtattattgcttagtcttttatttttagtgtttctgtgccatttagttttacatgtatttcataaatatagcatagtttgggatttgactgtgaatctgttcccctttctcatccactttctttttaaaataacatttaaactgatgagcctaaagattgagaactgacttatcagatcaagaaaataagatatatttgccaaacttaatgctgatgtacatttttacattaattctttgtgtctgaagatccaggaccagaagtttctaaggccagcatttcaagtggtatctggttctctatctattcttttgcctagggatgctggttaaatgagagtaaaacagtgcacacagcatttgcaggcttgctgatctgattgaaatttctgtcattaaacattttcatttggaaatttaatgttttgttagactaaatgatatgtaacaatatggctataatatagtgagtcttcctctctttctgtttctctacacacacacacacacacacacacacgcatgcacgcacacacagagctgttatttgataatgcataacaaattactgcttatgtgattttatttcattaaataaatgctatcagaattggtagacattatctttccataaatttcctgtggagttgtagaactgaaattcattcactttgtttccttatgctccacttacaacatttttgtttaatgcctgacttggttagtgttgactcaatacctatgatacaattttttgcattttaaatatgagccctaagcaactaggaggagctgcagctccatggtaaattgtaatctgtattgggagttcaatattaagaaacagtttagaaaaatatgtgacatatagaatttaaggtgcaggcttaattttacctacttctcaagtcttaccaattatatattttattcataacagaaattctgtcattattcttgatgattaacatcttgtaattaaaaacattttgctatacttttgagatctgcccttatttctgctgcattgatccaaagcaatcatactgaattaatttttgcttgagcagttcactataaatacaatgaaaatcgatcacttcattttgaaaagctagattggatacataaatttcattagtcattagataattatcaattccacatataatttttatagatcctaccagttacataataattttattaaaaatttactataacaaaaatacccaaaatttcattacatggtctttcagattttgtgtactgtgactctaatacattttacttctatataacagtgttcctttatagtacaaatttacagggaaaataagcttattaaaaagttgccggcagtaagacactgatacaaaatagtttttaacatagagagttgtatttaatttgtttaaaagtttagactaggaggcaagttttccctttttttctcctaatatgtactgtcttagcctgtttgtattgctataattatatacttgagcctagttgatttttacataaagtaaatttatttatcccaattatggaggctataaagcccaagatcaaggtgctgacaggtttggtgcctggtaaatgctgctctgttttcaagacgatgccttgttgctggatcctagaggggaggaaccctgtgttctcacataatagaagggatggaaggacaaataggaagggtctaccttccagccttttcataaggcactaatccattcatgagggaagagccctcatgatttaatcacttccccccaaatccccacctcttaatatcaccaaaatggagattaagttttaacacatgaattttgggggacattcagactatagcatatgcatatggacatatgcatacatgtaagatcattctaagtagggcactttaattttactcacgtgatgtgtagcactacatagttgtggttatgaactcaaatatggagtcaaataaacctgattaagaactttgcttttgctacttattagttcaggtgaacttaattttgctacaacacatccgtaaagcagtcataatatctactttacatattattgctataagattatcatggtgtttaaaatggtcacatactattattattatctaggaatggggtaagtaaagataactggtgcctcaatttgtaacatgtgcaataaaattaatccataaaaagtgaaataataaaaatgtaacttgcagtctatgatttctgagtgctctgcagttctaatagaggatgttatgaaaatcaataataaaagataggatttgagaatttcttcttctctacatttgaattaatgggttgattcccagctaacaggccaagtgatgggagaacattttagattccttcatatccacatgttttcaaattccaagggaaagatggcagaggacttcgaaactaatggatagcccttaaatttatgattcatttgttgtggataacactgaaccctcattgctcgttgagaactaaaggtaaatccatggggtatagaatcataaagccactggtatcaaatattttactataagaaaaaagaatgtagatggtaacaagtgttaactgattgcttaaatgatttcttttttataattgaccttaccccattaaatatgatctttatcactagaatgtaaaactgtgttgtccaatactacagttttcagcacacacatacttaaatttaattaaaagtaaattgaatgcaaaattcagttatttagtcagactagccatttcaaatgctaaatagacaaagaactacacagcacacagcagaatatacccatcataacagaaagttgtattagacagcattgattaagaccattgctcttcaaactttatttttttcttattgcccctgtacaaagctttttaaatatttttttctaatcactcttcatcatcaaattttacagccaaagatacatgttttatgtacctgtgtctaatacataaaaatagtaagatcccagaaaccttttgagaatgcatgatgtagacctatagaaagagaaaagaatcagtccatagataaacactatgaaaggcagaacaacacttaatcatgtgttcatgttcaaaacatctatgaaccacttattaaattttaccttcctaaatatgcaaataaatgtaattacaataaatgttaaggtaaatttaagagaatatttaactctattactgtattattttattaatatgcaagtgaaattaccatgaaatatttttcatgccaaatataaaataagaagattagatctgtgttatttatatttctaccatcttcttgtgaatatctcaggtgccaggaaatgtagttgatgctgggaaggctaaaggagatagaatagttcttggtcaacaaattttaaaaggctgatgtaaagataatgtaagtatctaaatttcccaatccgaaatccagaacattgtctactaaattatattgctttgatacatcaacaggaagtgatatgctgggtccagttaacactcactctcaatggccaactgtaaaatgttcaaaggttttgggagacaattggcactatcacattggtagtttaatatcagctatagtcaaaatatgtgcaccttggacatgagaaagaaaactgtgaatcagggattttagtttgctgtcagataaatgattgctaatcattcgccaacacatcactgtcaaacaccttttacaaaagaacaagattaacttctcatacccaattatcctaattccacagtcctttattaaaaccatggaaatcaagcaagtgatggaaatgtcaataagcccaatttcttcataaattccaggattagatggctttgtctactagaaaacctgctgaaaactcaccttaagtgagattttaatgatgtttggcaccaaatatcatcagtgtttgcactatctgttactctctatcagtaaaactaacatacagggcattaatgctaatagtgttggttttacaattaacagtgaactacacgaagataaatttgtcaggagcgcagaatttacataaggtctggaacaacttttcctggtctgggccagcaaagtgacagaaaaacaaaagagattgatctggtatgccattattttcttttttctgctaaaccaaatttccaataaggttactgctgataatactggttgatatggtttgtctgtgagtccccacccgaatctcatcttgaattgtactcccataattccgtgttgtgggaggtaccagtagagtggggcactgctgaaaagatacccaaaattgtggaagcgactttggaactgactttcaggcagaggttggaacaatttggagagctcaggagaagacagaaaaatgtgggaaagtttggaatcttctagagacttgttgaatggctttgacaaaaatggtgatagcaatatgaatgctaaggtccaggctgaggtggtctcggatggagatgaggaacttgttggcaactggagcaaaggtgactcttgctacattttagcaaagagactggtggtactttggacctgccctagagatttgtggaactttgaacttgagagagatgattaagagtatctgatggaagaaaattctaagcagcaaagcgttcaagcagtgacttgggtgctgttaaaagcactctgttttaaaagggaaacagtgcataaaagttcaggaaatttgcagcctgatgatgcagagagaaaaccccattttttgaggagaaattcaagctggctgcaaaaaatttgcataagtaacaaggagcagaatgttagtccccaagacaatggggaaattgtctccagggcatgtcataggtctcatggccacccctctcatcacagacccagaatgctagaaggaaaaaatggtttcatgggctgggcccagggtctccatgctgtgtgaagcctagggacttggtaccctctgttccatctggtccagcagatgtatggaaatgcctggatgcccagggaaaagcttgttgcagtgacagcgccctcagagagaacctctgctagggcattgtgggagggaaatgtggggttggaccccccacacagaacccatactgcggcaccacctagtagagctgtgagaagagggccactgtcctccagaccccagaatggtagatccactgacagcttgcacagtagacctggaaaagcctcagacactcaatgccagcctgtgaaagcagcccggaggtgggctataccctgaaaagccacaggggcagaactgcccaagactaagggaacctatctcttgcatccacatgacctggatgtgagacatggagtcaaaggagattattttgtagctttagaattttactgccccgctggattttggacatgcatggtccatataactcctttgctttggccaatttctcccatttggaatagctgtctttacccaatgcctgtaacctcattgtatctaggaagtaactagcttcctattgattttacagactcataggcagaagggacttgccttgtttcagatgagactttggactgtggacttctgggttaatgctgaaatgagttaagactttgggagactgttgggaaggcatgattgattttgaaatgtgaggacatgagatttggaggggcccagggtggaatgatatggtttggctatgtgtccccacccaaatctcatcttgaattgaattcccataattccacgtgttgtgggagggacccggtgggagataattgaatcatggggatggtttctgccatactattcttgtggtagtgaatacatctcacaagatttgatggttttctcaggggtttctgctttttcatctttctcattttctcttgctgctgccatgtaagaggtgcctttcacctcccaccatgattctgaggccttcccaaccatgtggaactgtaagtccaattaaacctctctttcttccaagtcgctggtatgtctttatcagcagcatgaaaatggactaatacactggtattacttcatctctccatattaagtgagtattttagattagtataaagcaattttgtgtatatcgtcgttcttaaatttctttttttctcaaaatagcctttctcacccagcactatgataaatgagtgagactaaaaccatgtaatttagagtttttatgctgttgggtttttttttttttgagtagaagcatagtttcagtgcttgatactcaataatgaattctttctcaaaatattttccaaatataccaatcatgagatattgcttccagaaacatttttctggtaatattatattttaaagattttctgagcaagtaaatctgtctcttatccatgggtaacatctttcttcaatatttaaatttttgtagacccttctttcacctactagttctaagtgaattataaggtttcttggttttctcctgatgataccaagctttttgaaaccctctttaggggaagctgatacttatttcatttggacaaactcaaattaatagtggaaatggatgagtagagttcctgttccaactttggacttttatactaacaaaatcatttaacattattttcactttggaaattaatgcattcaaatatatttccttctctcaactttatttcatggtaatttcaaaaaccattattttgctgtgatgttcagatcaaagtttcagcctcatccacctcaattaatttttagatgactgatattatagccatctactcattagctattagacacagacacataccctatgcaactcagcattgtaaattgttctttataaaacacctaatcaaataaattttagtgtggtggctcacacctataatcccagcactttgggaggcagaggcgggaggattgcctgagcccatgagttggagaccagcctgggcaatatagtaagacctggtccctataaaacaaatttaaaaattagacgattatggtggtatgcacctgtggttccagctactcaggaagctgaggtgtgaggatcatttgagcctgggaggcaaaggttgtaatgagccaacatagtgccactacactcctgcctgggtgacagagaaagtgcttatctaaaaaaaaaattaaaaataaaatttaaaatatataattagaatccattcttggctcttcccctttgtgtatcctaaacatactaagtttccttgattctaatatacacatcttggtcttagaatctttattcatcttccatggtgcataaaataatggtgaatcctatcattgatagcacattagatttgttgaaatataattgattttattcaagtttcttccaacaaaaaataatctctctctctctctctctctgtcattttagcctactcctaggccttttctctctccctgttttgctcccaacttcgggaatttcttgactccacatcctgtctatacaggtaactcacgaaaattcatttgaagtcatttctttcttctaagcgtcagatcctctttttgatgacttacttgaaatcccatatgattttattacttttaagtttaaaattaagtttttctccatcattccttctaacaaacatctcattctcctgactcaaaaagtaaaattctctcttccttttctaaactttcctccctatgtaaattacccaggctcaaaattgtagaggtaaattcaatttctaatacttttataagtctgctgctttaactaacttttttcctttctgttttcactggcataggtccagaccaggccttcatttttatttaaaatcatctaagaaactcttcttttgttttcttcaacttaacatatgtttccaaatttttcaaatcaatcatcttatagaggcagttcctgtaaatcgatttccttgctcagagactttcaataactctctgtttatccaaagtaaagtagaatccacatttcttatttctgattaatactggaaaagtaagtcaaaacttgtcctaccaataatgggctttgtggaaggaaaacataaaacaaaataattatgtcaagcctttcattaaaacattgcaatgtgaaagaacagctttaaaatgtgtgttctgcagggagaatacagattggtgaaggtcaatcatagttctggttattcctagaattgaatactgttcacgttctcaagactaatgggaaactgaggctctattagttacataatagaaataagaggcagccagattgaggttgcacattagtagcttttggttagataatttgagtttagaaagaggggtggagaaaaacaaatgggatctaaattatctcaagtataagaagaaaaaatttagttttattggagctgtgatagtttgaaatcatagttgatatagaatagacaatataatattattctcaaaagacatacaaagccatttcttagctttactttcagctatctgttatatattctcaaagcaattgttaattaacatttcagtgagaataattttcccaatataaaatctcattgattttaatattaaggtaaatacattatattaagaattgcttgatgtggtaatgcagtgaatttaggggaagtatttcattatctatatgcaactattatgaaataaattattgttttttattagtttactcaaaaagtaaaataaggccacataattaatcattgcatgtgttcacttgactggacctcagggtgtttaaatacctggttaacaactatttctgggtgtgtatgtgaaggtgtttccaggtgagactatcattcaaatctgtaaactgagtaaagcatattatcctccccagtgtgaatgaatgcccatcatccaatatattgaaagcctgaacagaacaaaaaggcaaagtgaattctacctgcctgtctgaaagctggaacattgattttctcctgccttgagacttggacttggattgcaacttatgccactggctgttctggtctaggcttctcatcctctgtaattgcaggagataattccttgcaatacaaaattcccctctctctcttctctctcctgccattctctccatctctgtgtgtatgtatatgtatattatgtgtgtgtgtgtgtgtgtatcctattggttctatttctctgaagaacgctaatacagattaaatgttaatgccaatcaaaaatgatttacaaaaatcctagtgaatatagttactacacttaaatgactataatggtaagcaaatattctcttaagtagttaataataattattttatatctcatatcctcatctttaattatcttttcagcagcacagtttagaaaagtctgagtaatctatgaattcttacatgctatatccaattttcctaaaataatgtcttgtaagtccatctccgtttccctggcaactgcctgagctcaccatttcactacaacccaacagtgtttttaaaagactcatcatgtcagcaatatcctttttggatttacactaacccctaccatgtctatttattttctaaaacaaacaaacaaaaaaaccatactttttttgccaaagaaattccagttattttcccttttcccaggggaaaaatgaatcttcatcacagacaaaaccctttgattcttgtttaccttcttaccctcactgtgaacaatttgtagagtggaaccctaattacatctatcaatgctgattggaaatgccacacttgaaatattttgggcgcttccttcctaccttctccaattgtgacaatgtattttcctttgaatctgaatatgtgtgccattctgtttttgcatattttcctaatacagtagtatagatagtttatttgtctataaatatgttcttatagctaccacattgggtcgaattatttatgtataagattctgagctcattacaaccctctgtctactgccccagttcctgaacacatgctgatctctttctctttaatacatgtggagaaaatgattttgattacgacagctttcaatagataattgagtgattggctcatgtaacttttcctctttccttcacattttttcttttattttttcagtctttaagaataatattatgtttttttataatttctaataacaagattatgctttgatcatttaaaaatcaaatgtttatatatatttcaatggttcctcttgaattgcagaataggtaaacagcaatcatgcagaaatttgaaaaaatgcatatgagttaagactgcttttatagtaaagctagtgaaaagcaagaggcacttctggggaagttttcagttaactgcattgctaggagattgaacagagagactgataacgaatgcgtgatgttttcaaacaatcaactcacacaggagacaaaattatgacatatagtttgtttccaatgagaatgggaggggcagtatagcagatcaggtggatgagctgaaggataaatgtcttagttgtactgaacaagcgaatgcagctggtgtaaatagcgtggtctgagtaatagtacacagaacaagtataggagagaatgataaatttagagattgccaccatggatcagaatatgagtccatctaatgttaaattcttcctatggcaataactaatatttagtgttccaaaggaagatgaaaactcaacagactgtgcctaggcaatttattcaatgttatttatcagatgagaaatttctgttatcagtcccatataaaatctttgaacaacttgaattatgcagtttgaataccctaatatttttatgctggcagaactgcaaatcatattgatgagcataaaggtagtgaagcttttaaaataatccctaaataatccctccacactattctattttcatttaccatcaaaaaacaatggttattcacatctagtgcaatatatatacaatttgaatgcattttgacatcaagcttgggtcacaatacatttaaaaacatgttaaagagaaaatgtattagcattcatgtagccaatacaatactagcctgctttacagaatgttcatgtttactgactttatatttttatatttataatttaattaatataatttttaaaatctctgagattcttagaaatatccagttggttatataagacaattctactaaaataaataaaagtaggttttattagaattatagtcagaggtaatggagtgaaaaaaatatttgaaactagaaatgtcttgggctttagtctttctgttgtcacattttagatcaaaaatatttggggagtcacttatccttcagtagatttctatttctgcatatttaagcagacttagcagcttaaacaccatcagtttattagctcacagttttatatattagaaatataagtgggcttgactctttttctccttagggtcttaccagactaaaattagttgttggccagacagatcttttctggaggctctggggaggaattttttataagctcattcaagttgtgcttagaatccagttccttacaggtagattgaacatgcacatttccttgttgagtgttaatcacaggccaccctttgttgctagaggcaacctgtgtaccttctcatgtagtgccccccatctttaatatcaccaaagaaagacttccccttatgttcaccagctggacaaaattttctactaaaaaaagaaaggtatgtgattagattaggcccagccataggagccccttttttatataataatttaatataatcatgggagttatatctcatcatattagtaggtttcactcacactcacagggagaagattacaggaaggcagtatttatggaagtcattcctacaattttgcttattacaggagccgatattttatctgaaaaaattgagattaattatatcttccatgaacaattgttggtagtagtagaagagctaatgtttagactcacttgccacatcataaacagcgaaattactaattgttctgataaacatttgaccctcatggatgcatattttatttataaacaagaatgtatgttagcacattctttctatattaactataaatctatctccttataatttcccccagcctttgaagtcaaacagataatatgtaatctctcatccatgtttattcactctgtggcattggtccagcatttgtagaaactccatttcatgtaaggcactcagtgctggggatcagtgaacaaaaatacatgacccccataatctcagagggtcctccctgaagaagtaacttgaaatgagatatggtagaagttaattaggtgaatagggaaagaatgagcctttcagaaataagcataggcatattagaaagggaaataagacagcaggaggaattaaacagctagaagactgaaaattattcaaaaagtgttacagtattagatagaaaaggtaggcagaacttgttacaggtagctgagagggagaaaagacagtaattgaaagccactaaagttttttaaaagttttttaagcatgaaggtaacataatagacattaattgtgagaataaaattattctatttactatgcagatgaaggtaaattagttcaaaagtaattaagaagaccgatcagatagaatattagactagttttgtggtaatagagatagacatgatttattttgaaatagctagatgacaaccaacataattttattgtaaatttaatatagtagggaagatgcaagggatattaggaatttcttcaagattcctagttggcatatgttgataatttgtgtatcattaactgttttaagttcaaagcccagcagtttaaacttgtgtacattgtggtggtttggcagtatttaaaatgagatatcaattagcatatttaacaaggtctggcatttagagtggagcagaaacttgagaaaataacatggaagcgactgcacatggatgaaatggagctgccaccatgcatggagaaggtggagaacctgattcagaagtcaccaaagagggttcagagttctgaacatcaagccagaaagaattattcctatgacttgaggcaatagagttttccttgatgacatctggacttgttgaaggccagtggctcctttgtttcgtgattttttttaaaaaaataaggacatccatgcctatcccaccataaaatgtcagaagcaaataatttatgttctagagtcaaagattcacatatggagagaaattttgcccaagatgaaatactcagagcttcattcatacctgatttagatgacttaggtaatacttgggacttattgatttgatgttatttagattaaattgtagacttagagttggtgctaaaatggattaaacttcagcctaaatgtccatgaataataaactggataaaggatacaccatggaatactatgcagccataaaaaagaatgagatcgtgtccttttctgggacatggatagaagtggaggtcattaactttagaaaagtaacacagaaacagaaaccaaatattgcatgttcttacttgtaagtgggagctaaatgatgagaacacatggacatatacaggggaaaaatacacagtgtggcttttcagagggtggagggtgggagaagggaaaggatcaggaaaaataactaatgactactaggcttaatacctgggtggtctgtacaagaaacccccatgacataatggtgatctgtacaagaaacccccatgaataagtttacaggtgtaacaaacctgcaaatttacccccgaacataaattgaaagtttaaaaaaagatttgaggattgttgggataaagtacatttatattgcttgtggaaagatcatgattttggggtagccacaatgtagacagtagtgggttgaatagtgtcctccaaaatctgtccatcaagagcctgtgattgttcatttcacagttttatgctgtgatggttagtactgagtgtcaacttgattggattgaaggatgcaaagtattgattctgggtctgtctgtgagggtgttggcaaaggagattaacatttgggtcagtgttctgggaaaagcagacccacccttaatctgggtggggaccatgtaatcagctgccagcatggccaggatacaaagcaggcagaaaaatgtaaaaaggcttgactgtcttagcctcccagcctacatctttctcacatgctggatgtttcctgccctcaaacatcagactccaggttcttcagctttgggactcagactgacttccttgctcctcagcttgcagacagcctattgtgggacattgtgatcttgtgagttgatactacttaataaactcccctttacatatatatgactaatacacgtctaccataaacccatgaatgtaaacttatttgaaaactgaatgtttgtagatgtaataaagttaagatgaggttatactgaaataagatcactcataagtccattgactgatgtctttataagattgggtgaagacatggagacatagatacagggagaaatggcatgtgcacatgggagcaacaattaaagtaacatgtgaaaaccaaggaacaccaaggtttgctggcacccaccagaagcaaggagagagtcatggaacagagtcttctctagacccttcagagggagcatggtccttctgaaaccttgtttttacacttgtacctaccagaactgtaagaaaacacatttccattgttttaaatcacccagtttctggtacatggttacaacagccttaggacactaacccagaaaatataggaaaagataaggcagacctacagtgataaatgagaatatttttgtttctttcttgccttttgttcacactatgaaattagagagacccaaggtattgtatgataaatgtgtagagttcagttgattaaatatagatatctctcctaaagatcctttcatataaataacaacatattataagttttaaaacttacatagaaataaaacttatgacaattatagaacaaaaatgggagagaagaaagagaagtatactcttgtaaagtccttatcttatgtgacatggtatactaatgacagtacactgtgtaactgtcatttatttgacataaatatcaaatatttgtagtatgttaaacaaaagggaaggtggaaagtctatgtgccattagataattttgtgtccagggctttctttttccatgcagaataccaggtttccaaacttcacagccgactatgagaagcttctgttatactttttttgttcaaatttgcctcaaccaattgagattattttgcaagtacaaactttaataattactaccaggattaatttgggtcttttgaaaagggaggacaattaagcaagaaaaatgctaagggttcaaacttatctcagtggagaagtaaagcagcttggtattggtaacgccgttgttaatataaagtagaaacctaggcaataccattcaggacataggcatgggcaaggacctcatgtctaaaacaccaaaagcaatggcaacaaaagccaaaattgacaaatgggatctaattaaactaaagagcttctgcacagcaaaagaacatcagagtgaacaggcaacctacagaatgggagaaaatttttgcaatctactcatctgacaaagggctaatatccagaatctacaaagaactcaaacaaatttacaagaaaaaaacaaacaaccccatcaaaaagtgggtgaaggatatgaacagacacttctcaaaataagacatttatgcagccaacagacacatgaaaaaatgctcatcatcactggccatcagagaaatgcaaatcaaaaccacagtgagataccatctcacaccagttagaatggctatcattataaagtcaggaaacaacaggtgctggagaggatgtggagaaataggaacacttttacactgttgctgggactgtaaactagttcaaccattgtggaagtcagtgtggtgattcctcaatgatctacaactagaaataccatttgactcagcaatcgcattactgggtatatacccaaatgattataaatcatgctgctataaagacacatgcacatgtatgtttattgcggcactattcacaatagaaaagacttggaaccaacccaaatgtccaacaacgatagactggattaagaaaatgtggcatcatggaatactatgcagccataaaaaaggatgagttcatgttctttgtagggacatggatgaagctggaaaccattattctcagcaaactatcacaaggacaaaaaataaaacactgcatgttctcactcataggtgggaattgaacaatgagaacacatggacacaggaaggggaacatcacacacgggggcctgttgtggggtggggggaggggggagggatagcatttggggatatacctaatgttaaatgacgagttactgggtgcagcacaccaacatggcacatgtatacatatgtaactaacctgcacattgtgcacatgtaccctaacagttaaaatataataataaaaaaaagaaattgtatttctctttcacttaccttcaattttttttttatatctgacagtctatttcaagatacaggtttctgttggggatcatactgtttctggaggaaaaatattaattaatttgttgtgaagtgatagtctgatgataatgaatcctttcggcctatttttcttttgaaagatattttcatttagacttttgtgttgacagtttttttaaatatcattacttttaaggtgtcactattgtcttctggtttacatagtttctgacaaaagtcaactgtttttattttagtttttattataatgttttcatattctctgtctgccttcaagattatctacggtttgcatcagttttactatttttatttagcactctgtctctcccccatcccccaccgcgtttgtgtgtgtgtatctgtatgtgtgtgtgtgttgtactcatcctgattgaggttctctgagctttgtggattggtgtatgttttttaccgtttttgtagaaatcttggcctttatcttttcaaaatttcttcttccttgttttctatttttgctctggaactccattcatatttatgattgactgttttatgtcttttcatagctcttcagtgttctgttcagttttccttttctctagtttttttcttatttttcgcttttattccaaaagaatttttcatctctgatattgttattttgtattgagtatactatttttagaacagttttgtattagttttagaacagtttaggggtttacagaaaaattgagagataccttatttcccctatacatattttctcctattatgaatgtctaatattagtgtggtacattaaccacaatgatgatccaatattgatacattattaagagttcatagattatattagggttctctctatgggttgtatagttgtttgggttttcacaattgcatgatgtcatgtatccaccattctagtatcatagaaaatagtttcactactctcaaaatcccatgtgctttaccactttcctcccctcccacatttattcctgatccttttacagtatttataatttgccctttttcataatgacataaagttagaatcatacattatgtactctttccagattggccttcttcacttagcaatatgcatttaatgtagctccagttcttttcatggtttgatagcttaatttttaaatcattgagtaaatttccattttactgatgtactggtttgtttatccatgcacctattataggatgtgttgggcttccagctttcaacaattatgaataaacctgctatgaacaattatatacacaattttatgtgatacacatttccaactcatttgggtaaatactagagaacattattgttggactgtatggtaaaattatgtagagctccataagaaagtgccaaactgtcttccaaaatggttgtgccattttgcatctccaccagaaataaatgagagttcctgttgcttcacattttcgccagcatttggtatcatttggtatcaaaaaaatatcattggtatttttttttcccagaaagggtctcactctcatcacccaggatggagttcagtggcacaatctcagttcactgcatgctcaacttcccaggctaaggtgatcttcccatctcagcctcccaagtagctgggactacaggcgcttgccaccatgcctgggtaatttttgcatttttagaagatggcgttttgtcatgttgaccaggctggtcttgaactcctggactcaagcaatccacctgccttgacttcccaaagtgctgggattacagctgtgagccatggtgcctggcctgcccatttttaaaggactttttttcttattctttcatttaagagttatttgtgtattttgaatataagtttcttaacatatgcacgtttcacaaacattttatctcattttgtgcttgtctttttagtccttcacaatctcaaacaacagaagctttaaacttataagtttccaacttatgtttttttttcttctctcatggatcaagctctagttgctatatttaaaaacttcatgccaaccctaggtaacttaggttaataaacactaagattaatatttctcctatgttaattttcagaagttttatatttttgtgttttacatttagatctataattctttatgagttaatctttagaaaatatgtaaagtttatatctagattaattattccttgtggatgtctagttattcctgcatcatttgcttaaaaaactattttattgagttgcctttgctctttgtaaatgatcagttgactatatttttatgggtctatttcttggttctctagtctgttccattgatttgtctatacttccaacaataccataataaagtatagtaagtaagcttagattgttggttttagatccttttatctaatacatgcactgaatgccatacatttccctataggtactgttttcactgaatcttacaattttttaaatccctctctccttttgcccaacctctggtaaccactatgagttcaacactttagattccatatgtaagtgaaataatgtggcatttgtctttctgtgcctggcctatttcgtttagttctccagtttcatccattttattgcaaacgacagaattctctttttaaaaaaaggttgaatagtattccattgtgtatgtacagcacattttctttatccattgatgaaattcattcatgaagacttaggttgagtccatattttgtctatcatgaataatgctgaaatgaaaatggagatgcagatatacttttaacatattgatttccattctttcggatatgtattcagaagtagatatgctggatcatatggcatttctatttttagtttttagaggaacctccataccattttccatatggatttactaagttacattcccaccagcaatttacatgagttcccttttttctccatgtccatgccaacattggttctctttcttttttgttttaaataaaagccattctaatgagagagaattaattgtggttttaatttgcatttccctagttattagtgatgttgagcattttttcatatacctatcgaccatttgcatgtcttcttttgaaaaatgtctgattttatttcccatttttaaattaggttgttttcttttgtttgagttgtttcagtttcttaaatattttggatattaactccttatcagatgtatgattcacaaatattttctcccattctttgggttgcctcttcactttattaattagttcctttgatatgcagaaatttttagtttgatgctatctcatttgtttatatttgcttttgttatctgtgctttcagagttatattaaaaaaattattggccaaaccaatgtaatggagattgttggctatgttttcttttagtaggtttacagtttcaggttttatattaattttcaaaatttgttttgagttaatttttgtatatggtatgagacagggatccaatatcattcgtgtgtctggatagccagtttttccagcatcactgattggggagactatcctttctctattgtgtagtcttggcacctgtgtaaaaaatcgcttaagcataaatatgtgggcttttttttgggttttctatcctgttccattggttgatgtgtctctctttttatgctagtaccatgctgtttttattataattgctttataatgtgctttgtaataagaaaacgtaatggtgtcagttttgttattgccacttaggatttttttcctattcagggtattttgtagttccatccaaatttaagataatttttttattttcatgaaaaacaacatgactaattggtatttatgctgtttcaagtatggttcaatgtacacaaacaataaatgcaggataccaattaaataaaattaagaaaaattatatgaaatcatctcaatagatgccaaaaaacctcatgttaaaattcaactgcccataatgatcaaaagaaaactttcaaaagattaagcataaagggaatgtacctcaacacagttaaggtcaaatataacaaacatatagctaacatcattctcaatgatgaaatgttgaaagctttttctctaagatcaaggataagcatgtccatcctcaccacttctttttaacattgtattggaagatgtagccagagcaattaggcaaaagaaagaaatgaaaagtattctaatagaaaatgaagaattgaactgtctctatttgctggcctggtaatctcatatatagaaaatgctaaagattccaccaaaaaactattagaactgataaatgcacttagcaaatttacaggatatactttcaacacaaaaaatcaataacatttctatatgctaataactacccaaaataatatttaaaaatatttatatctaatatatttatatttattaaatatattaatatatttatatttagttttataaatagatttatatttataagaatatttaaatattcttttggatagttactataaatcccatttacagtagcatcaataaaaatattacaacatgtatatttaaccaaggaggtaaaagacctgtatattgaaaactttaaaacactcatgaaggaattgaataaaacaaaaataatggaaatatatgccattttgatatggtttggctgagtctctacccaaatctcatcttgaattcctacatgttgtgggagggacctgatgggaagtaattgaatcatggggacaggtctttcctgtgttgctctcattatactgaataagtttcacaagatctgatcattttaaagaggagagtttccctgcacaacctctcttctcttgtctgctgccatgtgagatgtgcctttcactttcccctgtgattgtgaggcctccccagccacgtggaactgtaagtctgttaaaactctttcttttgtaatttgcccagtcttggttatgtctttatcagcagcatgaaaacagactaatacaaatgttattgatagaaataattaatattgtgaaaatgttcatgtgactcaaagccatctacagattcagtgcaagccctataaaaatttcagctttcttttgattagtcttagcatggtatatctttttatatctcttctatcattcacttttgaaaacattaatctctctcattgaaacaataactgccaaatttgtagcagttttctatttgtggcagtttttctttgtttcttacttttaaaaaacatattgtcccttttttctgtgtcttctggatccagtggtgcatcttatataactccatttgatctctctttgtgtatactatccttcctttttgaaaaatattgattgctctagagtttgcagtatgtatttacactaatccaagtgctatggaatccttgggctgtcactttgccagccagaaaactctgtggccagtggtgccattgcccaagtcttggtcagggccactgggcccacttggcatggcaggctgtgctcagctcatgctactggcctagatcccatgcctgccaaggttgagcagagtggcaagggttttgtcagcaagcgagtgtggggtcgggccactgcacacagccaggcacactggctgtggcagggctggaagctccaggcaccagcactggtgtcagctccctgtgtggttgtgactgggccagaagtactgcaagcagcttccatggctggtaccagggaatgcagtagcacctggaagttggatacaccaggacctgcagagccccaaagagggtgttgcagccctagcttggggagctcctaggtccgggctccctgaagggccacagctgttttctctttcttgttgcctgcaacatggtgagcaaggggtgtttttcagccctgtttgtgttacagctctttcagctctgccactcagtgggtcctgagttcttgtcccatgcccaggaagaaagaggtaggtagacaagtggaggatgagcaaggtgaagaagagctttattgagcaatagaacagctcagaggagaccaacagtggatagctcctcttagcaggcaggtcgtcccatcatgtcctggagtctgattgagttctgggtttccgcctgcctcagaggaaaggaagtgtgtgctgattggactatgggtggctatgggcaggcccagaaaaagcaccatgagttcctgctccggtctacagtactgacaacccagaccccaggcttcaggccttcctggcttaaaggtggggcttcactgggtacctgcccctttccacccaggaacttgtctgccttctgccactgttcatggtgtccaggctgttcatgcccaggggttctggcaggccagtgcggaactgcccttagcccctgcctcagattccctcccatgctcgttggtgcccaaagtccagagggggctgaggcggcaggggactggcatgtcagtgctcccctgagcatgcccacacacagctgggttgcaacagcacacgggcttggcctcaactcaactctgctcactggagggggcacaaggaacaggaagaagccaggcagcaggagcaggcacctctgagccagtgaggtcaggggtgcttcccagtcccgagagtgcagagatgcccgggtccacagccatggcttgggtggctgcaggtgtacctgggaaggtgtggctcctgactgctcccagcccccaagagctcagggatgcctgggttaacagccatggctggacagcctcagctgcagctgaggaaggcaaggcttccaccctgccatctcagaaaagggcagggcttccacctggtcctaactcctatcacaagtccacttttaaataaattttttcaaagggattttctgaaccttataatataacattcccacttcctccctctcatcacttattacattgctgtcattcatttcacttatccacaatgtacataatacatctttgctattattaacaattttaagactttgaacacttttaagaagatattttgttttaccttcatttactcctctaatgcttctttctttacatagattttggtttctgaccatgcttctttctttacgtagatttcaatttctgaccaatatcattttttcttctctccgaataattttttaacattgtttgcaaaatagtttactggtgacaaattatctgctttattatttaaagaaagtctttatttctctttaatttttgaaagataattttgctagacagtgacttctaggctggtgatatttttctctcaacactttaaatatttcatctcactctctttctacttctctgatttcgcatgtgaagtcaggtgcaatgcctattcttgttttcctataggtgaggtggtctttcatttccccctctgggtctttttaagagtttatctatgtttttctgtaatgaattctgcttctgttcagctgcaattctctgaattcattggtttctctagttttgtgtatgaaggtttgtcttgtcacctcaattatctggtggacttcagttgtttttcagctattcattttgttgttgtttcaatgattatgggagtgatgacctcagctttttgtgtaagagcagaaaacaatttttgatattgctcaatatttctaaattttccatttgactctttcttattcctacatttctgctataattgttcatcttttcactcatattatcttttgtttccccaaggtcttttaatatattaattatagttattcttaacttcctattaaatagttccaacatatggagtaatcattcagtcttgttctgtggattactcctcctctgtgcaatggctgaggtttttaaaaattattattatttttttgcaacttctatttttactgaatgccaggcattcgtatgtaatggcacagactgaggtgaatactcttcataactgaataagaaaatatattattcaattttctgctaatttacattgtttctgataagaaatcaaagttaattctaagtgtttatatgtatatattcaaatataatttggctacttttaagatagtttccttatcattgatttccatgagacttcgtgatacgttctctgtatttattccatttaaagttgtgttgggattttggaattctggatatgttgttttcagcaaatttagaaaaaggattggccaatagtttttaaagtacttcttctgctctaatattttaatcctctcaaatgttaattccattattcttttattagctcatgtaatattgtcccataggttactgggtctatacatatttttaactttttcttctctgtctgctttaatttgaaatttgactattcaaattcccacatattttcttcgccatgcattgtactattactttcatccattttagttttagaaagcatattatattttcattatcaagaaattcttctgagttctttccctttctctgttgagacttttacctatttattcattattcccactagtttctttacatttttaaacatttttgcaatatctgttttaagtagcacatggcaattcaaatgtctatattctctgaatctgtttctattatctgttttacttcccagatatagatcacactttttttcttcacatactttttaaaaaaatttatgctgaatagtaaagatatcacagtatataaggtttgcatattttattcctttaaaaatcgttcagtttgagctggtgggctgttaattgctagtggcctgacttgttgcttatcaagcctcctttgggtgcacttagaatagctctcattatatagcaatagtagctttatttttaagtcatgatcatctttcaactctggctggtcagatattcatctttcaacactctgtggactctaaacctgccatttatctcatagttttccaggaattttctgaaaacccttatagaatgttgtctatgaaagtgcaggtttgcattcaaccaaaaatctagggctcgtgcatattttaaattattatttttttcctgagaagctgcctcctttctaataccttccctgtaagtccaactttccaaaatttccaaatcaaccctgcaatctgatctctattatctgtatggattctaattccctatgctacattttggaaactagcttagaaagcaaattggtttcaatgtgacagtcatctcatgtgtttctcttgtgtcacacatcagtttgtaggtccattgaaaagcctttaaaatatattttatccaggttttatttgtatacagcagaagagtaagtccaatgactgattatcaattggatccaaaagtctggttactaatcataagtcatacatagatctattaaatgggattttgctaaatggaaggatatgtttttgtgacctcatccactgtcccccttggtactggctaaattatatttttagatttatattaaaagagagtttcataggccaaatcagagctaagttggcacaagtgctattgagaaggcaaaaataattttgagaaatacagaggtgctataccttctttttttttttttttttttttgacagaatcttgctctgtcaccaggctggagtgcagtggtgcaatctcggctcactgcaacctccaactccctggttcaagtgattctcctgcctcagcctcctgagtagctgggattacaggcacacgccaccatgcccagctaatttttgtatttttagtagagatggggattcaccatgttggctacgatagtctcgatctcctgaccctgtgatccacctgccgcggcctttcaaagtgctgggattacaagcgtgagccactgtgtctggcccagaagtgctatgactaatggactcatctgagattgagaattttaagttgacttagaaaggttaataatggggcaggcgcagtggctcacgtctgtaatcccagcactttgggaggctgaggcagttggatcacctgaggtcaggagtttgagaccagcctggccaacatggtgaaaccccgtctctactaaaaatacaaaaattagctaggcacagtggtgggcatctgtaatcccagctattcaggaggctgaggcgaattgcttgcacctgagaggcagaggttgcagtgagcctagatagcgccattgcactccagcctgggcaacaagaaggaaatcctgtctcaaaaaaagaaattaataatgttatttgcagatatcaagattctctatagacccaacttttctgtcttaggatattggttgctttataacaatctatatatttattcaaaagccaattatctagggatatttctgggctgtgaacaaaaatatctttctactttcaagtaactcaaataaataccaaggtgtggaaataaaaaattgcatatatatacacacataaagtctaagaaatttgagattatggtaagtactgttaagaaaataaaagagatcatataatagatattaaatcagtttataaagaggaaggactataggaggtgatttctaagaaggcaatatatgagctgatgtctaaagaagccaagtatgtgaacgccattagaaatgcaccccaggcatagaggagaaaaaacgaagtgttttctaaagagtgagtgatttttagatatgttacaggaaacaaacaaaataaagtttaatataggtgtgcattggaatgcatatattgaaaaagttgtcagtgtccaagtcttataagccttttcagtcatgttaagaaattaacttttattttaagcacagcaggaaaatcactgaagggtttataggggtaaagttatttattaaatgtatatttaaaattatgttcatttttttctgctatctggaaaagggaaggtaagaatgtagaaacacagatatctgttgggaatctagattttaggactcaatgaaggataatgataccctagactgatgtagctgcaataaagggaagaagtaaactaattaagattatttcattgtgtaaactaatagaactttgtgatggattggatgtgggaatgaagtagagatcagaatcacatatggttccaagatttatggtgtggtatttatggaagcttttactgaagtggaacagaaatcagaaattttaaaaaattaattacagacagtttggagattctttaaattgaaagtgttaagtaaaagattatgatttattaccagaaactacttcttgtctattttttgattctcataatcttatttttattaccatattacatttagcaatctgcttaaactgtatcatccattctttgcatgttcatgaaaatacatgcaatctgtctggagagatgataaaagttaaatctttatcatgattatttggaatttactgatactggatttctttcactttaaagaaaattgcctctttctattttagggaaatatttaatacagtcctactacagttgattaattgcatcctataggcaacaacaaatttgaatgtctctcttagaccttgagatctgtttcaatcaccaaaattatttggttgtcattttataaagtagagatataagaatgaatagcttctcaggttttttctttaaatttgccaatataggtcacgcttccctatggtttattatttattcaacagcctttaaaatatttaaagcaatagaatttttctgcctgtattgaaggaacattaaatgtgctcaaaaggcctctagttagatataatttttatgattcccaaactgttttttattttttagttatcattcctgctattagagttctaccattgaattgttattagataatatttgtagttctactttatattaataaaatatatttttgtccaaatatatctttaaagatgaaatttgtgatttttttcaatgacaagttctgctatgaaacaaatactttaaagttgctccactgtcctgagaatattaattttccaatttcaataaaaagagcagatggttaacattaagagtgatgaaacaggagatttaaatggttttacaataaaaaatgaaaacaaactcagttcatcattagttaaaagttacacaattgatctatcaccttcatattccaaaaatgtatacatatgcctggtaagaaggtaaatttattttctgggtgtggaatacagaagaacttttaaagggagaaaatattttagaaaggagaactcactatgcataaataaatttagaacatagctatcattcaataaatgttaattaaatccagatatttaatttgaggcataaaaatatcaaaaagaccatgtgtcttattttatttccagctttagatgaccgatttcctacaaacttattaaaagtttatagagaatttgttcatttgtttttattttagttttctacagatgaattatgtttcagaaaatgccaaacctgaatttcagtctcaaatcctctaccatctttttcacctaatacaacttatttaaatttgtcctgtcttctcaagtgtaaggtggaaatatgcttaattcagaatgttgagatatcaaatgacaaatgccttcaaattggtccacagtaggaactcacaaacattctatctttttcctattgcttttcttgactaacctatcaggcaggtgatcctatgacacatagagcaaaaatctgtccatgtcctcaaaaaccattatcaatattccattgtcaatgaaatctgagttctctatagatgcttatcttcttagcctgtttatcttatctttgatggcaggagttatgttctagatgttacttgtattattatagtatgtggtccaatattcatttactaaaccaagctgtttttatctctgaattttctgtaatattgataaaaacttcctttgcttgaacttccagaaaattccaagtctatgttagaaagccatacaaaattaaattctacttttgaaaataagccttcagactaagtgaattgtaattatttgtgtatatttcctggtcttttatcttcaatcaacacttgttataaaatgaactttcattagacaactgacattagacaagcttcactaaaagtatcattaattttgattttatttcttaaataaaaagcctgtggataattaaaacccttgtatatcatttagaagaagctctaataccatggattgttcgaatactcataaaatatataaagaaaagatggcatatttcaaaatcttgaaaacattgtctttattaattcatttacatatcattttaatcttatttaaattatatttttattttaaaaaatcacttcaagtcttctgatgttagtatttgtttgtttatttttaaatacttattgaaccctttgaatgtgacaagtgtggtttataatcctggaaattcacttgtgaataaacacaaatatttctgtactcatgtagaattggatatttttttctcattttcatagtgacaattttttctaacttattaaaacataaatgcatgttacaaaatattaatggagaaagcatgtaaaatgccactaaatgtaaattttctgttacagcttcgttatacctaaatacaaagccaatgtttccaatgattatgtaatcttatataactccatcatattcaattaactatgaattataccctaatctatgacttatgtggctagactattacgcaaaacatttaggtattattcttagaattaataaatttttgtattggttacttgataaaattcttgctgtatcaactaagtgggttggattgattatacataataaaccagagaaggtctccatatggaaggaggatattcagaaaagttcaaagatgggggagaatactattttctaggaagattaaacattttgtcatttcattacaggaacatatttttctgaaggtgttgattaaattatacaaacaggccatcaggttaaaaagaattacaatttgagtactacctttggaatttttctatcattctttacatgattactacaaacggacttgcacgagactttttaagctcagtgttctttcccttttgattttccccagtaaataataatatttcactgtctaaagacttccgactaaatatacttaattgaataagtaagagccttttaatcctttaaactgtaatttattaattaggtaatatgctagaaattgagttttcttagatctcagttgtgacttctcagttatcattttatcataccttacacttcattttatattttatatgaaaggattctcttatctacttatcactcagatacatcaagggagtggctctatgtcttgtgagcttaacagaaataactaccatgttccataaacatgaacatttgttcagactattataatccatgctcagttgtttttatttattctgaattaactaaaaatacaagttcctcaatctcatctaattcttttttgttttcaacaaacatgttttcagcatctcttttatatctggaccaggggatacagggaaagtccctgccctcatggaactttgttctcaagggaagaactaacaatcaaaataataaatgagataattacaaactaaggtaatgaatgagaagaaaatttaaaaaaaagatgacatagtgaagtaatttggggttatttcatcataaagagttcccttttaagagaaaaaaaatcttagttgagacctgaatagaaggaaatggccatgtgcacatctgaggaaaggatatttctgtagaagaaacatgatgaacaaaatctccaaaggaaaatagtgtagcatgtttgagaaataagcagcagctcgtgaacttgcatgattaaagagataatgttttgatataatgttgagagacaagccagagataaagcagattataaaagatcttgagaattaggttaagttttgactttattctaacaaaaatgagagggcattcaattattttaagtggggagttataagatctttttttttcttttttatgtaagacaagtctgtaaagaatttattggagaaaggtaagactagaagtaaggaggttgactgagaatatcactgcagtcatacaaaaaagagatggctattatttcaactgaagtgattaacagtggagaaaaaaaagacatctaagatggtcttttaagttagaactgaaaggatcaggcactaaatacgagggtgagagtaagaaaacaatcaatcatagtttccatgttgttttcttagatcaccggatggataatggtttctttacacaagatgagtaggaacatataacactgaaattccacttttaggtatataccaaagagaattgaaagcctgcatacaccccaaatcttacacataaatattcataaaagtgctattcataacagctgaaaatgtgcatattagaaagtgattgtgaatactcaaaagtcacaggcttagaaattacttgagaagaagtttacaacttagggtgatccttgatacagagtcagcttacaacaattaaaaaactaaaaataaacaaaaacaattacccccctcctcccccctccaaaaaaaaaaaaacaaaaagctgggaagtgggagaatctgatttgcagatttacaacattataagatcaaaatatccacttttcaacaaacatcacaaggcatagtgaaagaaggaaacaggaaaagatggcccattgaaatggaaacaaaaaacataaccaacagaaccttcctgaataatacctcgtggcagatctaccagacaacaattttaaaataattttcttaaagatgcttaagaagtaatagaggatgtggagaatgtaaagaaactatatgaacaaattggaaatatgagtaaagagatagcctaaataggaactaagagaaattctggagctgtaaactacaataacagaaatatgaaattcactggagggacttaaaggcatatttgagcagaccgaaggaaaaaaatagtgaatgtaaagataagacaatagaatttatgaattcagagaaacagaaataaataaagtttgaagaaaagtgaccaaagcctaagggacttgtgggataccatcaagtggaccaacatacacactgtggaagtctcagaagaagatgaaaaggaagggacacagagaatgcttgaagaaataatggcttaaattatcttacattcaactgagtaaagtcaaaaatatgaacatccaagaagctggcttatttcgctcaaaattaagtttctacgatttttctgctgttgtgtgaattacaattattgtgattatacaattatatagacatctaataaatatcttttacataatattatttgcataacatgccatttgcataatattcaatgttcccattaagaccctaatggatattttaaggaacaggccatcattaaactttttttctgctaggttttctcacagttgcttctcaaaaaaaaaaaaaaatcttgttttggtcacagagtggaaagtacctgtagatctacttaatatcccttttgaaaagattaggagggcattgtggtattggagttaaatgtctctaactgactacaggtaacacatgttttcttttaggcctgaaattaatgctatgtttatataacttcctaaatgaaatacaatacttttgggataaaaataaaagtcatctcttgctcttagagaggacaacagagtaaaagaaatgttctgagctgataaataaaggtaggtaactatgtctgctctcttggagtcaaaattttctctaaaggtcaacaccatactaaacacaatgctaaaaacacaattactaaaatgctagtcagctcctcccaaactctgtacaaattttgcagatgcagctttgatttgttttattcctcttgagagaaggtaggtttcaccagagtatttttgtaaatagtaattttccttagaaaattaaatctcagatgtttaaaggttaacagggtctttctgttatggctctaaaggataagccaaccaaggattgacaacaaagaatttgaaaaagaaggcaaccattcatttgccaatgaaaagagcagaaggctgagaggtgattataaaagtctttatccagaaatagataactctggacaaaagtagcaaatgaagggagtggatatattaaagatggagaatcttgtttctactgtcctctgaagttatggtggtagcaaattcaaatttatatagtagccaggtaaatagcctaaataagtacagttgacaactcatatgaaagggagagtgtatgtcccatctcaaggaggtaatgactcctcatagccagcctgttgttaccaaagtgaaatgtatgcccaatgtttacaggtcttctacattgtaataagaagcaaaaattaagggtatcatgtaatgatctaacttataaatattatctcacctttataaattatcttgcccaacaaaacagatccagactatattcaacctgtgggccacatttagcaagctgcctaataattaattaaatgttgaaaaccaatggtgcagtaagtcaaaactcctatcttctgatgatagaaaatctggctggctggcgatttcttgctgaggacataggatccagcccaaagtttctgaccacaacacatggaagtggaagtcaagatgcagaagaaggagaccatctcttatagcccctctgcttccagggagtggtagttgactcccctgtgtttagagatgagaaaatgtaaatcaatatctcacctttccttaatcctcacccactttaaagcctcagttgaaatctagagttccagcatcatcaaaattatgatagtgagagtaaacacaggaaagctagattatcttagagtctcaaaggaacataaacagcatgagtcaggaagtctaacatgttctttgcaattcccccagtacctagacaagttggcatgttgtaggagctccataaatggaccaggaagtataacaggaacttcaggagtgcagtcacacttagtaaagtgtgacttgatcaatatgctcacatgattaaatttgtttcagccagataacagtgggaactgttatgaaaaagactaagagatgaaatgctaaagagactaaaacaaggtaagatctgtaaggaaataacaaggaactaaaatagagcattgtattagactgtttttacactgctgataaagacacatctgagaatgaatgggcaatttacaaaggtaagaggtttataggacttactgttccacatggctggggaggcattacaattatggcagaaggtgaaaggcacatctcacatggatggcagcaagcaaagagcttgtgcagggaaactcccatttttaaaaccatcagatcttgtgagacttattcactatcatgagaactgcacgggaaagacccatccccatgattcaattacttctcaccgggtccctcccacaacatatgggaattcaagaagagatttgggaggggacacagccaaatcatatcaagcagtgaaattaattttccactacaacaccagaggaaagaatcctttcaaacatgggagacacttttatgtgaaatccaaagagttgatcccatagaaacagagagttaaaaggcagttgccagaggctggaggaaggagcaaggtggagaaagggatgatattgatcaaagggtacaaatttttaattagaatagaggaatatgttgtagtgacttatcacattttatgggtgccatagttaataataatgtattgcatatatcaaaattgcttaaaaatagatttttaacattctcattacaaaaaaaattatcagttagtggggagatggatatgttcattagcttgactgaatctttcaacaatgtttacataaataaaaaaacatcatattgtgcctcataaatatatacaattactatgtgtcaattaaaaataaataaatacataaattttacaaatgaaaaaataaatgtggcacatttttttctttttgcattagaaatattagggccaagatttcaaattgcaaatgtcttcaaagctctttgctttctaatggattatatttctatttattttccccattaaaagccacaattaaatggcctggtagtacttcaaaactttgatttttaagtgtctttaagatttctttaaatttgaccagtttgtatgaaaccacagcacatttcagctgaataatgacagtgcagaaaggcactttgttacagataaaaatcattgactttcggagatgccatcaatagtcatttagactagaatatttcagtctcaaaagtaaagatattttctcctttataggcagcacattgcattttacatggttgttaagatttatagattcattgtctagcttccataggtgaagtaatttcagactcacataaccaaaagaggtagaatttcattgtatcgaattctcttttcttccctttctactcaattagtgaaaaatctgtttttcaaattgtaatgtctcagatactgacagtaaggatttccatactttaaaaagtatgcagtatgctccatacctgggctttgggcaccttcactggattccttcctgttttgatttttaaactcattattttagtttggattctgctgaaatcagaacttaagatgggggcttgtgtgcagtaatgcatttggtagatgattttaggaagtaaaattgaggagctcgggacatgaaatcagagaataacgaagtcagtagaagaaatcttattatggttactatttgggcaatgactaaataattacataatgacctttagaaagttaataacatataatcaggattatccataagtaaagctggtgattagaatatttataaattaccttccatccctagttgtttgaagggtgtcttaggagcactgacttcttgtattttgagcctgaacgtgcctgtatgctaaggtagttcacatcgtgtatgaaaagatcctcaaagggagcaaagacttgatataaggaactgccatgatgaggcgagctgagatcactcagtacagctcattccaaatgcagtactgctcattccaaatgcaactgaaatcagaggctgaccaagaaagaggatgtagcctggagcaccagagtcatttgctatgtttactgcaggaagtatcaaggcctgctttctagaaatatacctgtaggtctgcctccctccatgtactctctgatcttccccattcaattgaccccaatcttccaagaagccagttgtgtatattttgcttggaatgtgctttgtacactcaattcttacctcaatttgcaccaatttgtgtgtgtgtgtgtgctgaggaagttggagaattaaaatgttcatgctttgggacataggtattaggtgtgctcttcataataactttgccagaaagccctgcactttgggaattattgagcttttgtgattacatatggcaatgtaatcttgtattttgagttctcacttatggttagaacttcagttgggtgctccgggctatatcttcttccttgtccagcctctgatatcagttgcatttgaaatgagcagttctgagtggtctcaactcacctcataatgaaagttccctatgtaaagtgctcgctgagtctttgctccctcttgagggtctttttctatacataggagccatccatgtatagaaagaaactatgaacaactgaagaagaagaaacactgaacaactaggaataacaaccacatcagagcctaacacattaaatcatccaataactataatttttggtaccactggtctttaattaggtcattctaattaaaatgttcttacataatttgttctgtaatgttaaaagtgtattttaatgttctatctattatatataatttatctgaggccaattactctaaaatatgtgatgccctagaaaactaaatataggtggataatgacctataaatatatgataattgatgtgtttttaatagacattacttaatctcaaatcattatcttattttgtagagtataaaaattaactgcttcaagattattttatattatataaagaatcaccaatgataaagttacttgtcttaatttgctattggtttcaatttagaaagatttattatgagttagtgaataatataaaaagtctaaattttgtgttttacttcacctctagatttactataaagaacaattttactttgtaatattacatcaaattatatcctatctgaatttaaaattaatgttatatactcacatatattgtattttaatttagaatgaacctgattcacagggttgtaaaaaattatctagattgtttgccacagtttcaaaaagtcagcattttaaaagtcagaattttatttcttattggttactaattttttaaatgttttttattggcagcatgagaagaaaattaaaagagaaaacactttatgaaaaactataatcactaagcagttacatgtgttaacattcaaaaagtttaaattgtatacaattaaaaaattaacttacttgaagtgaaatatgattttattttaaaaatttttgtgtgcctttaatgtcctaggcactcttgtaggtactgcaataaaataatgaacaaaagagagaaattcctgtgttcaaggagatttaattcaagtagtaagagagaaaataaacagttaagtgacagacttattaggaagtgctaattgctaggaagggaataaaaggtaattgaatagagtgacatagtgttatttttatataatgtaggtaggcttgtaagagaaacttctatacaaagcctgataaaataatacagaaaagcatgctatcagagggaagtgatacacacccagatagaatagcagaggccaacactgtggaattgagggagaaattagattagagaggtagctaggggccatattatacaggatttagcagaccaatgtaaggagtatgtgctttgttcaagtattttgggaagctacggaagattttgaacatgggagtgaagtgatatgctttaattttaaaatgatcactctgggtgctagatagtgaatatattttaacatcagaagagggaagatggagacaaattaagatgtcatatttcaggcaagagatgatgggggcttagactaggatcattgcaatataggttgtgaaagtggttgaattaaaatgtattttgaagatgcagccaatgggatttgctgatggactgcatggagatgtgtgagcaaagagttaagaataactccacagttttggcctgagaaactgggtaataatgatgccatccactgaggtggacaacactaggcagaacacagttggaataaatcctcagtactaatcagtctgaggtattatatggatacctgaatgaacatgttagtagttatttgggtatatgagttgagagttcaggggagacacaaagattcatagaacatatttgggaattattagtatatttatggtattttttaaatggttgaaattcctcaatcagtgaacatatctaaaaatagaaataatgatgatctaaacaattatgcgatccactaatagtaagagaaaacaatgatgaaattgataattgcggaaacatggagtgcaagtttacaaggtattttacataaacaaaataggtaaaatgctactgataatatgaccacaatgtggaaagaaaatggcaatggagaataattagtgacctccaacaagaagaataccattttaatcttgggattaaagcatgattggaagtgggattgaaagagaataggtagtgaggaaatggatattcaatagacagcaggtttcaaaattcttttttttaaacaaatcgagtagtagtttaacactttttacacattgtagaaagattcaaaaacaaaatgaggaaaaggtaaatatttattcatatgctgatagcaagtgatatagtatggagagaataatttatgctggagaaaataaatgcaggataaactttccttaacaataaatgaggctgggtgcagtggctcatgcctgtaatcccagcactttgataggctgaggcaggcagatgacttgaggtcaggagttcaagaacagccttgccaacatggtgaaaccccatctttactaaaaatacaaaaattagctgggtgtggtggcgagcacccgtaatcccagctacttgggaggctgaggcaggagaattgcttgaggtggaggttgcagtgagcagagattgcaccactgcactccagcctaggcgacaacagcgagactccatcggaaaaaagaaaatatgataataataatggagagaatccatacagcagtagggcagtagggttgacaatagacaggaatgtggaaaaacagaaaatgtagtctatgaatgcagatgcgtatagtttggtagttgttagtgcgaagataaagaagctttcttctgatggcttttattttctcagggatataagaaacaaagacaattgaaacttcaatagagaaaggattgataatggtgtaaaaagataaagctagaatagtaggctaggatactcggaaattcaattgattcagaagaagcaggattgtcaggcagcaccaagggctttcttgagatttgtggtcaagaaatcaaggtaagaacattcattctcattctctctctctctctctccctccccccactcataatttttctctgtgtgtgtttgcgtgtgtgtgtttctttaagcacatgcattttttttctgacaagtaagagtgattttaataatgagtcctataatgtaggctgggaacatgggaaataaggatttttttttttaacaagagtcaaaattggcagcctgaaaatagcattaatgagcaattcttggaagacttgtattttcctactcacctcttcagctaatgtcatgccagcctcttggtcattgctctgtgcttctttcctgctgcaacttctatcctcctggtgtttattttgccctgtgctagaaactgcattgatattttactctctgaagttccattaacacgcatttttgtttgcattatagaatttcactaagggtttgaagaaataatttagagcacggtagaaaaaataagttgaattttatgtgttgcccttttagcaatttgttggcttttttgaacagaactatctaactggcccttaggttctggctcaccaaatcttgtcaaatctattttctcactgtgtatgtcctcacctctatctccacctatcatttcctatgaaggggaaaagacccaccaataatgacatttcagctttctaaaatacaatagctggctttgatgctcactcacaaatagtatcaaaatcaccagtcaggcattcccattcattcagatttttcagttagcattttgatggttctctcttagacattaaccgatattcaaggattttctcatattaaagggatatctctaaataaatagatacataaacaagaaaatagcacatacacgcagaaaaaagaaattctgaaacactgaggcaaggcaggaaaaaaacatacaaaaagcttcataaatattattttagagaaaatataagatattttgtttgtgaacattgcagaatgcgctaaaaatattaggtaagatagacagttttggggaactgaaatgaaagctaaatattaacaatgtaatagaggcactggaaaagaagatgtaagtaaatcctcaaatgagcaaaaaataaaattagagaggaatattgatatatttacaatattattgacaatgacttctgactaataacatttttgatataactatgtggggaggaaagagtaagaaaacatatttggttagggggatagggataagctaagttttaattatccatagaaacaattagatatgtgaaacacagaagagaaaagttcaagaaatggtagtataattgtgccatttagaaatatagaggtaaatatcagaagtattaagagtgttgaaagaagttgcttctggaagcaggtctgctgtgttttatattattctcccacctcctcactcctgctttatacaggcaaatcataccttttccagagctgtcgctggtataacacctctttcttcctagtgtcattatagaattagttacctgattctgtaactgttaagcatagtcattgctaaacacagggccctcattacacacaggcggaaaaagcaaagcattttgaggaatctgtgaatttgtaagtcctttaaaatcagattagtctttgtacattgtatattttttcctaatacctcaagactgcaagactgctaactatagctaaaattctgaggtgcttcccctatttaatttatgatatgatggtgcttttttatataattgtatatacatgctatgaagattctaatgtcccatagacatatcaaagcttcttttttgctttactctcttcttctaattattcaattacataaaaatgtaaatatcagttagtaaggaactatttcatctttatatgtaattaagtgtaattttggttcttgatctctctctacctctccctctctatacacatttgtatatctgtgtttgtaccaatatattataggcatcttgaacccaaacctaatcaactttttccgtagctttcccttaatgttccatttaaattcacttccccaactccttaccttcatcctggtccccataatcatttgtttttaatttctttttagaatttttcctgtggaaagttaataccatataaggcaattaagctattatatctcatatatatctatatatacatatttatatatatttatttataggtttgtgtttatattttacacacatacttatgtataagagattttatatatatatatacacacacacatatatttctatacacacgctctagtatgtatattatactggccttattttatatattatgtgtgtgtataatatataaaataaatgtgaataaattttttttttgatcatagctttctgtcagaactttgagagttaaatcctccaacccttctaggaagtagtattgccattctctgacacacctggcctgaattgatgcctgaatcaattcagaatttactacatctattgagacactttgtccatcctgattactgcataacaagttcacctcatgtctcatgctagtgcattaatccaggtgcaaaaactaccccctaacaattgtatgtgagctgggtttttgtacccttatcatcatttttttgacattaaaaagaaagctcatttctttcaatatgagaagcctaaaatagagttaactgaaagtcatacacatgagaacaagttattgattgtagtggcaggagactaagtgccgaatgatgttgtataacagattcactgtgccaagtctaaatgtctggaatatcatctgtgggaaaattcaacttcttattttagccactgtattttaatattttagcatttttttgttagcaaaggtaatcttatctggatgaatatattcagttatacatttttttcatatctttggaaatatctccgattactttacatatttagttggattttgttcaatatctctctttaccgtaacataagctcctttagggtagggaaccttctctgttatgttcaccagactttactgagagttttcaacaaggcttgggatgtaagaggcacgtacacatttgtgacattagcaaatagaaaatgcaattgcattctgcgtccattcatggttataactcaataaaataagatattggctattaaaatttgcatctggatagtaaatctagaatataaatcttcaatgtaaactctgtaagttttattccttctttgcaattgttcctcttgccatttaagctgatttaagggcttacttaaataaacattgttttaagaaaagccaaggacagtctataaaataagttaattaaaagtactattaatgtttgtaattcaatgatataaacatcatttttcaaagtgcaatttcaatgtgtaagatccagcttttgataaaagagaaatggatttgcgagttctaagtgataaaggcaattttataatgaggttttggatttcaaatgaggatgagacagcttggacatagtaagcaaagcccatggaagagaacatggacatcaagagtctataccagtacacagtacccaaataccagggacaatgtctttctccattgcgtccagattaaacagagcaaaagagtgacggatctctgaataaaaaagatattcaactccaaaactgatataactgaattttgtcttgaaaaagtcacacatcgacttggcacattgacattttcttctgttagatgaaattttacccatacattatatggaattcattatgacacaaataacatatatgtttgcacatttgagttgtgaaagtgaattttaaatcttgtcacataagggaaaagtggttgagcacaattcagttgcctgtttaatgtagctcctgcctacattaacagaaaaaggaaatggtaaatgctatgttaataatgttgctgtcgttgacaaaaaaaaatgattactattaatctaaagctaaatataatcaaataccaaatattttcctaaatgtttatatctatagacttatagttatcaatcaaacaaaaaataaacactaaaccctttgtgtttaaattattacagatgcataatgtgtaattagaaatttgaagttgcttttacatcttttatttcccattcaattaattatctttatattctattttaatatatcttgttaaactaggaactcagctgacatattgtaccagagtagactaaactttgatggagagaagagataaaatggtgagcaagtagatttggggagtctcctcagacgaactgataattaaatcagaatttcacaaaactataagttcagtggataaaatgggtgatatagaagaaaataacagaagccaagagtctaagaaaagattcctatagaaagttgcatctgagttatggtatgaggatcagtacttgcaataggataaatggggtattttaggcagcagaaacaatataataataatatctttacaataaccaaaaatgtacaattgatcaattgtccatattttcccaaactatgcttctttatacatgtactcaaggcagattgttttacttcttatgtagattgggcatttggcaaaaaatgtattcagaagacagcttagttatctcaagcagaaaatattataactgaatatagtcatacgtttgcatgtgtatatgaaacatatccaagaaaaaatgtgcatcgctttgaagcaaacataattatattttattattctgaactattgaattgtatatgttttctacatggcattattatcaaagttattatttctgagataggacttaggcattttaaaaatatttatacttttctagtagatatataaatattaatatagatataaacacaaatgtagacatgactacatgtaatcacatttaaagtccttaagcacaagttcataaacttttatctacagattaataatatataatcgtgtctagttaagaggagacttcttgctaaatgagtgaatattttagaaagcaatataaatttatttatattcatctttcctatatttaaatcactaataattaaaactcaaattcgtaagccaatattctttaggaaagacaaagttagacaacactgcaaatctactgataaactgatttatatcttttgcaagataaaatgcaagcctttgatcatatgccatcacttgtgtacttcctgttcattaaattcagtcaactcactaccactacgtgtgtaaatttggactctgtgatagtgtttaattaaaaatactctagataaattaattatagaatggctttaaatagtcaactttgtaaatgtttattatcttcttccaattctagataccacaagtcttcataagaataagaaccatgtcagccttgatcatcacaaaacctcaacagctaatagaatacaaatcataaaatgaagaagtatcgagttaatcactgatagcctgtgtacatattatttaatgtgttcttcaaagaatgctctgatttagataattaagaatcataaactttcctggtcagagtcttgaaaaatttatatccttaataacttggttaaatgtattcataggtgtaggcaaagctaaatttttctgaataatatatttggttaccaaattttaacacatttaatattgtatttaatgttattttaactttcctctctatcactaataccattacattcaaattttgtttttttctgatggagcaaagctagagtagaaataaaactggaattagagagggatgtgtattttggttccggctctgtcactaccagatgtatgatcttgaaaaatatacaaaagtataacatccttgtgttttaaagtttaagattctttaagtaaaaccttgcagtgtcatgactctcttgaaatggaacaacctaaaaatgaatagatttgaacatctcacaaaacagtaatgctttaggagccttgaaaaaaagatttccagagaaggctaagaaaaataaatgctattaagtgtctgagaataagaaaaagctttatctgtccatgtatgaaagagaaggtcaatttgaatgtcaaaagagtatgtacagaaaaacaaatacatgtaactttcttgagggggaaaacttctttttgaatgtccagtcatgtatctttcttggtttgaaaccaaactgtaacacatatttcataatattttttctatattcaactgtaaattctgaaagtggtacacttttaatttcttatcttccactgaacctaaaaatggacatgtgagcagttttgctcagtgacatattagcaggttttgattgttattctaaaaaggttctccttatagaaagactcaatacagttagcaccactcttttcctttgactcaagtgtagaaataatgacttaagtcattgcagtagcaattctgaatgcatgaacctataatcatgaattaaaaactaagaaaaccattaccccatcctggtactgtcaagtcactggaccaacaaccattagctgtctacctacagaattcttattatgtaagaaaaaatgaaccctatctattaaggataacaattaattgagttttcttttacttgtagctgtaccaatatgcaaacatatattaaaacatcttaaatcatgtgccactggtaacatcttagataatatcattttaaaacaatgctaagtaccatattttgaaatgaaattaaagaggttatcaaaagaaaaataaagaacatgttaatctttcaaatgttgatacatttaaaatatcagagcaaggtgttataacaaataattttacaaaatgtgtttcttagtcatgttgagctcagtgtgttgtttcttattttaatacttctagcagcagtaacaacaacaaggtgaatggcattgctgagtggatatatatggttctacattgatagctcaataattttgaagataatgggcaatgtgaaacttagaaagtaaactgttttatagttgaaatttaatgtttcttgtatattatatgtaatgaactttgcagaaaatgatactttttgggaaatattaacttaatctgatagtttttgtgtatatgagatttgttaccaagattacctctgaagccatcaagatttctcaggaaagacaccttcatatttctttttaaggtcacgtaactttctctcaccttttgattacttattctctggaaatacttctagttcctttccatttttgcttgccaatataatttccatgtgtctagtattattttatccctgctggcagagaacctaatattagatgtatttaactactcatccctcaggatagaaatccatatgattttagtgctgcacaaatcagatgttaataaactgagatttgagatgtaaatacattattgtaatctctgtgggaattgtctgaaaaaatacatatgaaacaaaataacacaaaaactatattattgttagtcccatatcattaatactagtatgccaaaactaaaacaatatagctatttgtattttgtaaatgcaatttctcaccagaaatttagagggctaatgcctctaccttctataagctccctgatgacttttgcctttatgtttggataaaatttatgctgtgaaataattgatactgacagctaatgccaatcttcttttgctttacatttaaattcacaatggctgtctttttatgtaaatatttttaatgctaagcatattctagaaatgacagttttgtaacagatataataatgttatttctgttagattacccatacagaaatacttttttgtatattatagccatgcaaacttactaaagatacatttactgtaaaagataaaaatgtaagataacttaaaatctaatcttaggatttaataaattgaagataaaacacataattttacttcttattaatttcttttataagagacaaattatctcttgacatttttgccctgtttgcatctggcagattatttcaggttttggagtataaatatgaggtttctatttgcttgcagacagaaatatgttgctgcacatgggacagatatggatttacctgtataaccaggggcacagaggcagttgtatccatcagtcctgtagacacaattttcttcatctagacaaggtgagattttacatttatttacatcaagttcacagaagggcccatggtactcaggttcacaattacaaaaaaatctggagaaaagtggagaaatgaggaatagccatgtaacaatgataatcatttattatatatgattcatatttatattttaaattcaagacattcaacttaattgaaataaataatatatgtatttcatttttttctttgaaaaaatatagcaattctccttgcaaaattttgttctgctcaaatgttctttatgtgtgaaattttgaaaaacaatgtgttgggtaaataattactgtaacctgataaatactagtatcaaaatatagatgaggtcatgtcctttgtagggacatggatgaagctggaaaccatcattctcagcaaactatcacaaggacaaaaaaccaaacaccgcatgttctcactcataggtgggaagtgaacaatgagaacacatggacacaggaaggggaacatcacacaccggggactgttgtggggtggggggaggggggagggatagcattgggagagatacctaatattaaatgatgagttgatgggtgcagcacaccaacatggcacatgtatacatatgtaacaaatctgcacgttgtgcacatgtaccctgaaacttaaagtataataataataaacaaacaaaaaaaaagaaataatttccaaaggagatattaaactgatcgaaactgtatacttagcaaaaatatctcttcatagtttttccttttagaagtctagataaagaagctttagcaactttccataaaatgtttttgagctagatttctatttagattttttaggaaactcttcctaattaacttcactcatcattttataaccacagaagtctaacattccccatgctcctccttttacttcttcaacctacattaattaattgagcgccagacattagtcatgtacccatattcaagtgtaaattaaactagagcttgcttttgaaagtctcaggaacaggacaggaatacagatatgtaaacattacagtaaatacatgtcaattgagacaggtcctgttaaagcatggctagctgctagacaagaggtgacagaaaaggtcttactcagtattaataaagaaggagcaggatcagtgttttaaaattctgaatatgaatgaaaacatgcagtatttttctttctgtgcctggcatatttcatttacaataatgtcctccaggatcatgtatgttgttacaaataacaggacttcattctttttcatggctgaagagtatttcattgtttatgtatactacatattttttattcattcatctcttaagtaaagtaagccagacagtaggggagaggggataggaaagattgattgatgggtgcaaaattacatgtagaaaggaagaataaatttggtgtcctattgcacagtacggtgactgtagtaaacagtaaggtattgtatattcaaaagagctagaggagaaaattttgaatgtttgcaccacaaagaaatgatgaatgtttgaggtgatctctatgctaattatccttattcgttcattacaaacgaatgaacaaatgtgctgtaatacaatgtattatgtagtataatgatacaatgtattcatgtatcaaaacaacacaacaaaacaacacataaatatatcaattatgtgtaaatgaaaaataaaattaatagaaaaagaaagagtaaggaatctttgtatcagttggacagaaggcattaaaatgtcatgtgcaatgggatactgggtgaaagagtagagtatttcccaagagctcttcatgtgactagggaattgactataatcacctttttggagtaacactaatccaaatactaacttcttgaatttttgttcaaatagtcaaactgtttttctccattgtattcattttgcgaatatctccccatctagtgagaagtaatgtaatgaatctgctaaatgtcttactaaaatcaagatatgtttgttaataatactgtctttgctactttgtgttctcactgaattaatgatgatcccaaggaatcacagaatagagagaaattggacacagaattctcagaaatagcagtgaaaggtatctcaagaaatgatttgtttcatactgacaaatttaaaaatgttatattactataaaaacaatgactttcatttcaatttatgtatttctttcatgtacttctgacagttctattatatttttagaagtttcaaaatctactttgtattttgaaatattgaatactagaaaattatttggtgatatcttgctttttcagtgatttatgataatcaccaccaattgtttcaattttttttaaacagtagtttactacttaatttatagaattttctctctctctcattttgaaaatcagaaaatcataacatcccttgtcttttgctccccaaattttgttttcggtgattttcattatcttaaatatacttacttacttgttgcataagttaatgggaaatttttgtgaaatgtctttttgtcatgatgaagatgtgggttttgctgagtattaatttttttttgtctgtatagttatcttgaagatacatgaaaggattcagattctgacacctacccataattcttgttttttcaattatgatttccttctgaattttgccttttgaaccctttgttagtttttactaaatgttattgttgcgggaagtcagggaccccaaatggagggaccgactgaagccatgacagaagaacgtggattgtgaagatttcatggacgtttactagttccccaaattaatacttttataatttcttatgcctgtctttactgcaatctctaaacataaattgtgaagatttcatggacacttatcacttccccagtcaatacccttgtgatttcctatgcccgtctttactttaatcttttaatcctgtcagctgaggaagatgtatgtcgcctcaggaccttgtgataattgcattaactgcacaaattgtagagcatgtgtgtttaaacaatatgaaatctgggcaccttaataaaagaacaggataacagcaactgttcagggaataagagagataaccttaaactctgaccgccggtgagctgggtggaacggagccatatttctcttctttcaaaagcaactgggagaaatatcactgaattctttttctcagcaaggaacatccctgggaaagagaatatgcacctggaggtataggcctataaatgccccccccccccaaggtgtgcccatctcttatggttgagactgcaggggtaaaatagaccccagtctcccatagcgctcccaggcttattaggaagaggaaattcctgcctgataaattttggtcagaccagttgctctcaaaaccctgtctcctgataagatgttatcaatgacaatggtgcccaaaacttcattagcaattttaatttcgtcctggtcctgtgatctcgccctgcctccatttgccttgtgatattctattaccttgtaaagtacttgatgtctgtaacccacacctattcgcacacttcctcccctttgaaaatccctaataaaaacttgctggtttttgcggcttgtgaggcatcacggaacctacagacatgtgatgtctcccctggacgcccagctttaaaatttccctcttttgtacgctgtccctttatttctcaagccagctgacgcttaaggaaaatagaaaagaacctacgtgaatatcagggcaggttccccgatatgttatattcatttttttgcttccatgcccatccttcaaatgtatttactctaatttaagatgaacttctcaaaaagttctgcttttttgtttgctctttaacatttatcatgtaacttattttatgaatctcaaatatgtaccttacgcttctgattttgaaagtgatatcacacagtaaataaacatacatgtattatctcaagacttatggaagtttatttttctaaagtttttggcatacagacaactatgtgaagaattgtttttaataatatgaatcataatgatcctttcttctaagaatgctttgcttctacttcaataacctctctttcctttttgctttcaatcaagaccattattttttcttactttctacactactcctgaaatctgaacttttcaacattgcaaaaatatgctttacttttacataaattccaaacattattaaatttcaagaatctgttaaaccacagatgcctgttcaactggaatgttgggggtccctgctttgttaataatgatgcaaaaaggccctgggattctagagtccatttggacattttctgaatggcatctaaaatttcatagagattaaaaaaaaaaaaatcatcgacattaacagcagccctggtgaaacagtttacagaaaatattcaacttatatttcttactttccaccacactaaacaatatgagggcaaatttgtgcgaaaataacattttactctacaacagagcaactacctttaatccttgtctctgctttcccagaaaaatttaaatgtttttattttctcttcctcctttcctccctccacctgccctgccctgctctcttcccgctccctgtgtctaataggaagggcaagcacaatgctgagcacttgggacgtttttactttgcacttaacgttggcccttcaaaacgttaaaaaaataaaagtgcctagggtatgtctgaaaagatcctcatcaaatttttcccctcctggcctctggctatagtgtgcaattctttcagctttggtattttcctttcgctattacctgctgagggtccctttatgctaaccacctctaataaggctagagaaaaattaaatgtaaacctgatttttattaatgtcctaagtgatccagtcaaatgtacagtcagtactgcattttatattaaaggtccctaaagtataccttcctttgataaaactcaatattcatagcttttaaaatatacatatataataatatcttctatcttgagagaacaattaagaccatgaaatatgtatttttgatgaaataaaaatttctcatttaaataaaaagcttttacttcaaaagttttagaattaaacttaaatatattgtcaaagtattgaaataattcatatttttaatttgacattgccctaaaatttttcaaataggtgttcaagatactttttcaatcactaagatgcattttaacagtgacttctgaagaaaattcaacatattaaaatagagataaggaagagtaactataatttgcataaaatgatatctccaaactataaaaagatggaaaaatacaagataatcacatgaatttatagcccccaaattagccacgattacatttcatttacattattcttatatactttttcttgtattccagatgagagaggaattaataagtagatgtattatttgtatgcttctgaagttattttaaaatataattattaaatagattgaatagtattacaaaatccaaacataacacagaatgttttaatgagagttttgattttaaaatgtgtttgcaataaaattaaatcatacttgtttcagtagatattttttaaaagcttacattcaaaataagaaaatgaaaccactggtgaaactttctgataaggacttttaagcctatgttaaagtaattcaaattttgaaagaatttataatgtattttaaagcatttctacttttttcttgtgatattataactgcattcatgaaccacacttctttacaatgaatgacaatttttacttagaatatgaataatctattttatatttgcaacatgtctttattatgttatatataaatatatgtctacattatttatcatactcacaacatgtctttatatgtttttattataattgcatgtgggtgtgaatctgatttgaaacagtgatgttatcgtaaattctctagtagaataaacatcattcggattgatgactgtttctaggcaaacaattacagaagagtaaacagatttttgtcttttggttaaatgcatattaaccaatcacttttaaatttgtaacagtgaagaattgctaaacccgtgaacatcacaaactgaatggtcacaatatgcttgttggtaatgatctcgctatgataatcacatcagccaggcacttggaacattttcttctattttttctttaaatgcactagccactgttattgtaattgttcttgcaaattctatttagttgtaaattttcagtagatggatactattgtgagtgacctaaatgaactagtagcaatgacttgaaaagacattagttgcatgggataacatatgctatcaagtgtcagaaaaatgtaaattccagtgttcacttttgcagtggatttgtatattaattggggctgtcattcatgtgccattatatctcagcaaattcatctttaaatcatgttactagaggtaagtcttaattgttgcaggccacagtttcaataaccataagagagaatagaatagattaaaaacatgaatctaaccatgaggcatgtatgtagtaactactgtttttaatacgttttttgtttatgtgtctacagtttaatttactttgaagtaactataaaattattgcttttaaatgagttggtagattacttgaaatatttttagtgagtactttatcaataggttaagtttttcaaaaaaataaaaattactttaagaagagataagacaatcaaatgtgactacttcattttcagctgctaattgatttttaatctgtgaaagattttaattcattgaaaatggcttttattataataatttacaccaggtaattttctaagaatagaataatcaacacctgtatgcccatcacccatatttaactcatcttagtattgtttcatgttgctgaaatatttttaaggaaaacacacaaaacatatttgatctgtcatatatatatatgagatgtcataaatatgtatgcacacacatatatgtacacacatttcatacacatatatgtacacatatttacacatatatgtacacacatttcatacacatatatatgtatgaaactcctatgcatgcattcaattaattatcctccattcctctctaccaggagaaaattactactcttaagatgctatgtatttttcaaaatatgttttaatacttcactaaatatgagttacatatcacattattctgagacttattttttcagtcaatcatacattttaataaatatttaagtgatatacttttatataatttattcacagtaagtaatgtatagatgcttatgattaagttgcattgcatttgttttgttttctaatgtttaccaatataaagatattggaaaggcatcaccttgttcatatatccttgctgacagtgctggatgttgccatggaattgggtttcgtgatgttaattacaatagatctaagaatgcatagactattggatatgcttgacaattagatgcaaaatgagcaaataaacatataaatcagagaaacagagtggacatcagtggactgattcacagatatctatggcagaggctaactgatgacggggttttagaaatgaaatatataaacagtctacttacggtgctgcctcatgtatatagaatgaaatgtatagttctggaggacagagacataattcagtttggctttgtagggattctctgcctctttcacaattccaaaacctaagttatgtcacagactcagtcactcgaaggtcaggttttgcctccttaagaggaatctttaatagagtcacaggtattttgtgtatctttttgaagacttcctcagaggtatctgaggctatttaccagtatgactgttctatggtgaaagaaagatattcagacattttaggagttgctgaatactggttctgaaagtatacttatctctgcaatgctactgatccaccagtagaaatataagattattgaggtcagttcaggtgaggccacaaatacatcttctctttgattttgtttttttttacccacaattcttgaatatacagtgtagttgatatatttagtaataggacaatttttacattggggtaagagctattatggaggaaaatccaattggaagatcttgtcatgcccctttagaccaatggagattttaaagtgacagcaattctctattcctgtggtacttgtagtgattggtgtccccttgaaaggactgaaagttgcaggggtggtgattccaaacatccctacttacctcaccagattggacaatgcaaaagctagaaagggcacagaaaataagatgaatgatagaatattgttggaaaattaaacaggatctgatgcaaatttcaccaattctaaaggttggatctctatgaagatagataaacagagctcctggtacctgagtccagctatgacatagaaaattaattattttgtgttctaattagtgaagctccacttgaatttgtcagaatgtctttttaaagatattttgaaagacctaaataaatagatatcaatttttcttaaattggcctacccattcaatgaaattccaatcaaaattgcttgtttgaatgtatatttatatagaataaagttgattttaacagaagaaattgccaaaatatctaaagctgcctgaagattaaatagccctactagtattgagatatttcaaagggaagtaattaagatgtatgacactagcacatggatgagtaactgaactaaagcaacagaacagcaatagagaaatagacatatccatatgtggaaacgtgatctgcaaccaagaaggcactacagatcagtgagtgaaagatgaacttaatatgtagcagacatggcttatttatataaaaaaataagaatctgagtttattttttaagtgtgcaaagaatgagataagaatactttacacccatactcatacttatacatacaatatacctgatgcatctacatataaagaacataatcttaattattttaaaaggaaatatagggaaaaaatcctttcatcctagtgtaaagaaaagttaaataagatgaaacttgcaaaccatatactaaataataaattaattcaagtatattaaaattaagttttagtacatataacttataaaggtgaagtgtctatttcaatcagaacttatattcaataaatacaactaacaaagatattttaaaaatcatatataaggattcttacaaagccataagaagaaaaaacattaaagagcagatgctgactcagcaagatggcagaataggaatagctcaggtctgcagctcccagagagacgaacgcagaaggcaggtgatttctgcatttccaactgaggtacccagttcatctccctggtactggttagacagtgggtacagcccacggagggcaagcagatgcagggtggggcactgcctcacctgggaagtgcaaggggtcaggggcctccctcccctaaccaagggaagcccagagggaccttgctgtgagggatggtgctatctggcacagatactatgcttttctcatggtcattgaaacccacagaccaggagtttccctcaggtgcctacaccacaagggcactgggtttcaagcaaaaaactgggtggccgtttgggcagacattgagctagctgcaggagttgttgttttttttttttttttttcgtatcccagtggcacctgaaacaccagcaagagagaacccttcactccgatggaaaggggtctgaagccagggagccaagtggtcttgctcagcagatcccacccccacagagcccagcaacctaagatccactggcttgaaattctcactgccaccacaacagtctgaagtccacctgggatgctggagtttagttgagggaggggcgtctgccattattgaggtttgagtagggagttttcccctcacagtgtgaacaaagccgccaggaagttcagactggtggaggggggggccaccacagtgcctcaaagctgccgtagacagaccgcctctctagatacctcctctctgggcagggcatctctgaaagaaaggcagcagccccactcaggggcttatagataaaactcccatctccctgggacagagcacctgagggaaggggcggctgttggcacagcttgagcagacttaaacattcctgcttgccagctctgaagagagcagtggatcacccagtacagtgctcaagctctgctaagggacagactgcctcaagtgggtccagggctcccatatctcctgactgggagacaactcccagcagcggtcgacagacacctcatacaggagagctctggttggcctctggcaggtgcttctctgggatgaagttccagaggaaggagcaggcaacaatatttgcctttctgcagcctccactggtgatacccaggcaaacagggtccgcagtggacctccagcaaactccagcagacctgcagaagagggcctgactgttagaaggatatctaacagacagaaagcaatagcatcaacatcaacagaaaagacgaacacgtgaaaactccctccgaaggttaccaacagcaaagaccaaaggtagacaaatccacaaagatgaggaaaaatcagtgcaaaaaggctgaaaattttaaaaaccagaatgcctcttcttctccaaaggatgaaaatttctcaccagcaagggaacaaaactggatggagaatgagtttgacgaattgacaaaagtaggctttagaaggtgggtaataacaaactcctctgagcgaaaaaagcatgttctaacccaatgcaaggaagctaagaaccttgataaaatgttagaggaattgctaactagaataaccagtttagagaagaacataaatgacctgatggagctgaaagccacagcacaagaactttgtgaagcacacacaagtatcaatagctgaatagattaagtggaagaaaggatatcagagattgaagatcaacttagtgaaataaagcaagaagacaagattagagaaaaaagaatgaaaaggaacaaacaaagtctccaagaaatatgggactatgtgaaaagactaaacctacatttgattggtgtacctgaaagtgacagggagaatggaaccaaattggaaaacacacttcaggatatcatctaggagaacttccccacctagcaagtcaggccaacattcaaattcaggaaatacagagaacaccacaaagatactcctcgagaaaagcaaccccaaggcacataatcgtcatgttcaccaaggctgaaatgaaggaaaaaatgttaagggcagccagagagaaaggttgggttatctacaaagggagcccatcagactaacagcggatctttctgcagaaaacccacaagccagaagacagtgtggaccaatattcacattcttaaagaaaagaattttcaacccagaatttcatatccagccaaactgagattcacaagtgaaggagaaataaaatccattacagccaagaaaatgctgggggattttgtcaccaccaagcctgccttacaacggctcctgaaggaggcattaaacatgaaaggaaaaatgggtaccagcctctgccaaaacaagccaaaatgtaaagaccattgacactacgaagaaactgcatcaactaatgggcaaaataaccagctagcatcataatgacaggatcaaattaaacacataacaaaattaactttaaatgtaaatgggctaaatgccccagttaaaaggcacagactggcaaattgtataaagagtcaagaaccatcagtgtgctgtattcaggagatgcatctcgtatgcaaagacacatataagctcaaaataaagggatggaagaatatttaccaacaaatggaaatcaaaaataaaagaaatcaggtgttacaatcctagtctctgacaaaacagacattaaccaacaaaaatcaaaaagacaaagaagggcattacataacggtaaagggatcaaggcaacaagaagagctaactatcccaaatatatatgcatacaatacaggagcacccagattaataaagcaagtacttagagatctacaaagagacttagactccaacacaataatagtgagagactttaacaccccactgtcaatattagacagatcgatgagacagaaaattaacaaggacattcaggacttgaacgcaactctggaccaagtggacctaatagacatctacagaactctcgaccccaaatcaacagaataaacattcttcttagcaccacatagcacttattctaaaatcgaccacataattgaaagtaaaacactcctcagcaaatgcaaaagaatggaaatcataacagtctctcagaccacagtgcaacaaactagaactcaggattaagaaactcactcaaaacgacacaactacatggaaactgaatgacctcctcctgaatgactactgggtaaataacaaaatcaggcaagagaaagaaataaagggtattcaaataggaagagagaaagtcaggttatctctgtttgcaaatgacaggattgtatatttagaaaacctcatcgtctcagcccaaaaactccttaagctgatgagcaacttcagcaaaatctcaggatactaaatccatgtgcaaaagtcacaagcattcctattataatagacattaatagacaaacattaatagacagagaaccaaatcatgagtaaactctcattcataattgctaaaaagagaataaaatacctaggaatacaacttacaagtgattgatgaacctcttcaaggggaactacaaatctctgctcaaggaaataagaaaggacacaaaaaaatgaaaaaaattccacgctcatggataggaagaatcaatattgtgaaaatggccacaccgcccaaagtaatttacagattcagtgctattcccatcaagctaccattgactctcttcacattattagaaaaaaaaactactttaaatttcgtatggaaccaaaaaagagcccatatacccaagacaatcctaagcaaaggatcaaagctggaggcacaatgctacctgacttcaaactatactataaggatacagtaaccaaaacagcatggtgctggtaccgaaacagatatatagaccaatggaacagaacagaagcctcagaaataacatcacacatctacaaccatctgatctttgacaaagctgacaaaaacaagcaatggggaaaggattccctatttaataaatagtgttgggaaaactggttagccatatgcagaactctgaaaatggaccccttccttacacattatacaaaaattaactcaagatggattaaagattaaaacgtaagatctaaactcataaaaactctagaagaaaacctaggcaatatcattcaggacataggcaggggcaaagacttcatgactaaaacaccaaaagcaatggcaacaaaagccaaaattggcaaatgggatcgaattaaactaaagagcttctgcacagcaaaagaaactatcatcagagtgagcaggcaacctgcagaatgggagaaaattttgcaatatatccatctgggaaatggctaatatacagaatccacaaggaacttaaacaaatttacaagaaaaaaacaaacaatcccatcaaaaagtgggcaaaggatatgaacacacacttttcaaaagaagacatttatgcaggcaacaaatatatgaaaaaaagctcatcatcactggtcattagagaaatacaaatcaaaaccacaatgagatgccatctcatgccagttagaatggcgatcattaaaaagtcaggaaacaacagatgctagagagatgcggagaaaatgtggagaaataggaatgcttttacactgttggtgggagtgtaaattagttcaaccattgtggaagacagtgtggtgattcctcaaggatctagaactagaaataccatttgagccagtaatataattactgggcatatacccaaaggattataaatcattctactataaagacacatgcacacgcatgtttattgcagcactattaacaatagctaagacttggaaccaaccaaaatgcccatcaatgttatactggaaaaaaaaaatgtgacacatatacaccatgaaatactatgagctataaaaaagaatgagttcctgttctttgcagggacatggatgaagctggaaaccatcattctttgcaaactaacacaagaacagaaaaccaaccactgcatgttctctcttataagtgggagttgcccaatgagaacacatggacacagggaggggaacatcacatactggggcctgtcaggggttggggggcaaggggagggatagcattaggagaaatacctatgtagttgagtatatatatatatatatatataggcagatgccataattaggcatttctaaaaaggcaaaattaatcatctcaaaatgtacataaaattgttaaacttcatattattataagaatgcagggagactacaataagatataactttacacacagcctaaaatggaacattctgaaaatgccaataaaaacatttattccctgctaataatacaaaaattgtatttttcaaaagaaatgagaaaaatataaatgtgatttagcaaatgtgaccatgtttacccaatggttcaacaattctacttctatgtatgtaacctcggacatactagtacttgtgtatttagagaaatatttgaaaactttaatatcattgtaggtaagacaaaagaagcaaatagtccaaatatctataaccagtagaatgataaatgttggtatatatttaatattaaatattgtataaaagttaaaaatgagcaacagatacatgcatcaacaggaattacaaaatattatgttcaacaacaatttcgggagactctacacaatattgttttgcttataataacatggaaactaaggagcattttgctcaggcacacatacaaatagcactataaactaacagtaagattggtaaataaaaatttgagatttttgacataagtgattggatgggacaaatgaggatgtgctggtacaagcacaaatgtatcagtggtgatcagctgccttagttacataatgagcacatgtgtgctcactttcttgttgaattacacacatcaaataattaatttaataaaaagtagcttctcacctgtttgtcagatccacacatgttccattatttttgcaaggttcagaggaacattcattaatttcaatttcacacagagatccagaaaacccaggtctgcaaatacaccttttaaacaaaaaatttagtaactccattagtatatatgtataaaatcaatgcttcaactaattgtagcatggcaagtttttaataattataattgttgcttaattcaccaattaaaattctatacctgtatacatctagacacataaacatgtatctagatactttttaagttttctgtacctgaaattgttgaccatatcttcacagtcaccataatcctggcaggaaaggaagaggcagtctttcacatcaatttcacagtttttaccttcaaattctgcaaagagtatgagatgagtatggatgagcaatccttgttatagagtaaaaaaatcagaatcagtggtagtctaaagaatacactcataatggaggttaaaaaaggaaaaagaaaataattactctcaagcttctcataaaactccatttcacataatgtgtgcataaaaacatgccagtttctagattaatgagtttaaatgaaatattcaagggaggaatactccactaaatcccctgagaaggtagagatgttgctaatgttgctgttgttttaaggtatttaaatgtttgaacaagaagaattgaaatgatctggaaagcaaatgaattaatgtgatgaccaatcttaaagtaaaattgagcttcaatgatcaaatttattcaaggcagttagcagatgaagcaaattatttaattgctttttatatccaagtgattcaaagaaaacaaattattttgattcacagctacataatcagtcatccatttaaacacatgccagttatattaaaaaaaatgaacatgaaagaaaattatacaggctgataaacaagacagttgcaattatttcaacacatttgtgtcagaaaaaacctgcatgatatcactttttaaaatacaatgaaatatattaatatttataataaacagttaaacaattctatggttatatattaactaagtataacaaaatatatgtgtaaaaccatttttcttgttaatattttttctgtactagttcaaacatgtaagaaacaagatttccctttattttgctttttcagtgatattaccaagcactaaataagtgcagccacattacacaatattctaaatgtcagtatgcaatcaggctaatttagtttgaggaacaaagagtcattcaggttactttaagaaaactgtattcattgtttgcatacacatagactggaattggaactaagaagcatttaaagggaagcatagtctagctacccaggaatagctgtcttccttttacagtacatgtcctttatccttctcatatcactttttcttctctttctatcacaaatatctcagcatgttcagtttcaaatcacttgtaatgttggcatgcgagtgatatagcacagctttcttggtctctatgtctatattatgacatttcagcttcagcacctactgttcaatgaaaaattccctcggtattttctcactcagattcccacgatagaacacggaattgactgacctatttcatcttttcatatcataccatgccacagtcaatgccattctctgtggtgtctaccattggatcaaactgcaaacctgcctcccgttgcaatttaacagggagcttggtgttacaccttataaaatctggctgcctcttcggtagtatataatatggaaaactaaaagttacttaatccaaaagaaaacagaaaaagaaacaaagtacagatacaacaaatagaaaacaaatagctagaaggtgtatttacagccacacatatcaaaagttatattaaatatgatttttaaaaacgccaatttaaaggtagaggcagactaaataacagaagaaactacaagatatctaaaagaaatttatttaaaacataacaacaatgataggttaacatttaaaagatggaatgatcacacactatgaaacactaattgtaagtaagctgccatacttatggggctagcagaccaggtagtcttcaggacaagcaatatttttaatttgccttatttttcttactcaattctcagagcctgcaaatgaatctctgaagttacatttttgtaattcgttcatacgctaggtgttgtatcctcagctttaggaacaaaattaaaatgaattacttccaagttattatggctctcctcattttaggtgagcaagttgtaattgttccaacatgcttcatcattcttcaatcgccattgctgttttctatatttaggttgtaaatgccatagtacagatataaacaacttagattctattttcaaaagatgtttaattctttaagtatttgattgaggttagatttttcacaagttaaaaattgagaaagttgagtgtatttcaccatttctactttaagtctggttagttttctctgggaggcagggcattttgacactaaaatgattcttagaaatgttcttttgaggcagtggaactcaggggcactgactggctataaagaagcaccagtgagcctccatgatttcagctgtgctgatgaatcagaacactcagggcccaggaccttgggtagctcacaggataaccttgtttcctgtgattttgtcatatttattaagtttgacatttctgagatggagttttgttaccagctagcaacatatgtcaatgggttgaggaaatgagattgccgaaatgcagcagacattgggagaaaacataacatgtggattgcattcaatataaagcaaagctttgctgagatagcctatgttttgggaattttaagagcgaagtatgcatacagtcacgtgctgcataacaacattttggtcaatgacagaccacatttctaataacaatgatctataaatattataatggacctataaatgcagtaggctatctcatctaggtttgtgttagggcactctatgttgttcacacaacaaaattgcctagtgatatatttcttaggatatatccccatttttaagcaatacatgactgtatacttaatcccaaactacatattctataatccttaatgttagaagttgatattcatttctgtgaaaggtacttgttttgaatatatgaagttacaggtaagaaactgcccaaacagaaagtttgttattactaattttatgctgttcccctgttctttattcctactcagaactattcggttggccgtactttgttaactgcagggaggatctttacatgcataaaagtgaagcttcttaaatggatactgtcttgatccttttcttacactgtctcgtctgtgtatggctataacaaatacacacgaatggtcagtaaatgatatttttatacttctgcactcgttcctccaaaatacacaaaattgatttttaaaacctactgctcaaatgtaagatctgcatcagtctggattgtaggtattattttttaaaatcacttagtattttctcttttctaacaaattcagcctttttgcactttattgctctagaaggtaatgtatggaacagagtacaataatgaaattttcataaaaatcattttacatagcattttatcattcaggactatattttaacaatctccacttcatatttggtattagttggaataatttgaaatgaatgtaaatagggaaaaaaactagtgtataccatagcatgaattcacacaaggtagttaaaaatcatatatttttaaataaaaactcaaacacttaaaaatgtttttctttcaaaagtattaaatgtattatttctatttattcttaattaaataatctaatttctctggatttaaaagcttgataaaaagaaaacaaaaaaacacctcagaagtttttcttagcaagtcagattttttaaaaaaatattattttatttaaaaatatttgtattcaaatattaacattttctaaaataattaaccaatataagaaattctttaaatttaactttaaaaactatgaaatatgaatatacagaattaatatttccaatagtctctaataagatttttaacatctatttttaaagtgaacttaaaaaaaagaagagctaatattttagaaagtaataaatatttaacatgttttatgtttaattatgtatgtattttctttaaggaattttctaaattcaaatttctacagctattaaccttaacaggtatgtgctacaacatgggtacatgtttttaattgtcaacaggagtaatttctaatttatacaaactattttgtcaaatgacacatttatttggtgtttgtacttgtataccttaggtaatgtggaattaacataatgatagtatatatactggagtaatagacacatttaaatgcaactacttgtctcccatgatactgcaattccatcaagcgtaggatcccaattgtaaatcaatagcacatgtaaatgatctgattctgctctcactgcagctccttgtgaggcatctttgccacattttaatcctgtcatttaaagaaacttctgttcctttcaccttgaagacatacaaagtagctattttagaaactaagctctttacattaaattaagaagtatttgatagggtaattttttgcctataaactgagaaagtggagtaattcaaagtagaaagataaagaaccattcataaaaagaacattagaaaagaaattatttaattcttgacatgtatttctaggctagacacacacatggtaacataataattctactctatgctacaaacacacacattctcatgcattttatttgaagtcgtctttaccttcttaatcttcatgtggttttgtggtatttattattattattttttattattagagacaaggtcctgctctgttgcctaagctgaaatgcagtggtgtgatcatagctcactgtaaccttaaactcctttgctctagtgatccctcctgctttagcctcctgaacagttaggactgcaggcatgaaccaccacgcactgctaattttttttaaatttttttgtagagatattatgttgaccaagctggtctggagctattggcctcaagcaatcctcctgccttagtctcccaaagtgctgtgattacaagtgtgagctattgtgcctggccctcaagtgatatattttatatttgatttctaccagcttgaagttgaaaccagtttattcaacctttcccacttaattaactctttgccttcactatatgttttagccattactctaatggccataaacatatgaataaaaacatgaacttagttaagaagtgagatatattggtaacccagctgagagggataccagacagttcacaaaattgaagaaagaactgtaagttctgccaggattccttccccaaacacttctatcctactatatacagatcatctccacatgaagagaacatggtagttgactgtactgattgaaaacatctggcagaaagagaaggcctcttctctcagcatcaactctaaagaaggggtctgaatgccaatattccactcacatgcatgcccagacataggtaaatcatagttaccatggggatggaatttactatgtgtcttagcttgggttgttccaaaaataaaataaaaaaaaaagtctgagataatgattttctcacaagtagtttatttgagaggtgatcccagatcccaggaattattgcaagggagtggaaaataaagcagggaagagagtggtttaatgagcacataattgtgggcaactgaggcttcatatgctggagactctcttataaatcatgcgaaacataactaaaagttgtcaacagaaatgagaaagcagtgctatgtatccacaacttgtcatcccttgtgcatatttctggcataaatgtggaagtgatgcaggatttttctcagcccgtttggcagactcgtgggagaggtgccccatctacttggtctattatgctcaagcttttgggggagagagcacatatgccagcaagtgcaggacctggctggccactccagatgccgaaacaggagcaagctccacacgggcccccagcctgaccaggtgtgttgccttggcgggaacatggtggaacccaggtgagggtgcctgtgacactgaagccccagaggggattttacagtgctcctttagttccaccattcacagacagcagtgtgttagcagctcagttggtgccttgcctcgtcacatggggtggctgccctttgccagggagggcaaagggctggttggacggcctttctgggtacccacactcagtgggtcccaagctcttgtccagtgtccaagaagaatgaggtcatgcagatgattgaagggtggtgaaggtggagaattttattgagtgatgaaaacaagtctcagaggagaggggagctggagagggtacaggaaggacaggtcgtcttcctgtacaacctgaagtcaggctgtctcttcccgaaagtcaggccatctcatcttctactgactgagtctggggtttctatagacacaggatggggagtgcttgctgattggtttgtgagtgtgcaaaagttaaagtgaagacaagactcaaaggtgggtacaacagtgtggaaaaccaattaggaaagggcaggtatatgtaaaataggtgaagggtggggatcaatcagaggaaagcgcaccaaacaggaagacaagttctcaatcctgtctgagaatttaacttatagcttggctttcaagctttaaactggcattggcttggaggtgatgtttcaccgggtacccacccttatctgtctaggcatttggctgcctcctgtcactatcaaaagcttttaccgcattgtactttaatggttaattaactggtatgtctctcccttaaactttcaattccttgagggcatatcttcaccatgtttaatttttccagaacctatctcaagacttgacacatcataggaaatcagtatgtttgttgaatcagttaatatttttaaaatttctagaacactaacaacaagcagttacaagatagatatgtatttgtgtatggagtacagtttatagaggcaaaaaaagttggttacaataaaataaatttctaggtgtgtaaattcattacatactaaataatcaaagctaacactattgaggtgtcaaaaataaaacccatttgtttatagaaatctcataaaatgtgccttcctatgtgttatttttctatttattaaagctaatttcttacagatattgtgcctattttcttacagatattgtgccaaactaataagattttatataaaataaccatattgaattattactgtcacatgctcttttgcctcctcattttcctgtagaaaatgttcattattcatagagacccaattaatcaccgcagttttagtcagaagacagaagctttgccctttatttatctcacaaagcaggatcacaatagttctggtgcttaactataccgataattttttaagtagcttactttgctaaaaggattagattatttttactatatatatattttttactatgtatatatttttactatatatttcaatcacactaaccaaaatagcttacctgctaagcatgcagtctgacgtaaacccaaaagtatcagttattctacttgctggtccttcagagtgaatttgaatgtcatttctaatatagttttctaacatacagtcgcattgttactctggctgaaattttacctatactcatatttatctagtgagagaccctacagactgactaaaaactgtgaaaacaagttcagaaatacatacgctgaatccttagcctaaagccttaaatttctactcttacgacctgtcctattttagtcaattgacaaacaccaacaacttacaaagagatccagtggagcttccaaatcatatctgtagatgttaagtcttggaattctttgtagttctaaatgttgatacttgtgagaattaaatttgataaaatgttttcttttaaaaacaatatactggctttgacatagaacctattttaaataaagctattaaagtaacccagtcaaagcttctaaaatgttgcatagtcaacttttgaattttctgaggtggtttttaaaagcaatgttacagcctttaatttttcatctgctacagaacttaaaactactaaagacacgttattacagtattcagatctgatttacagaaacatactccacaattaggtttagaaaaacatagatgcaaattagttaaaaaatgatgtgcatttcaagtatctctttgtactgaatcacaatcacaaaggaataaacacataattcactgtgtttacctgccactctagccaaagctctgatttggcttacgtacaataataaaatactaaggggaaataagattacatttatttaataatagtgaaatctaaattctccccatgacatctttgtcaatgttcaatgggacagcagatatcattactagttcaatatatgactagagggttttaaaatgtttccaaactttctttccctaaacccgtagcaggaaagaaatatcactatattttataaatttattaaatgcacttataaatagcaaaagaatttttaaaatattaaggtttgaaaacaatgcccactttgcagaaaattatctctggtgaaaacaaaggaagtttgtctaaagtgaataaatatactatggcctcctcaataaatatttatattctgagattttttttctattttacttagcctacttatactctcagaaataataatatgtttcttacattcttagacatgtaagtaggctaagtaaaatattctacgtagtagaatgtttagaattgttctagtaaataaattagcttcactgatattgaataattttcaacaagtttcactctcagtgcttgctaaaaggaaaactatttacttgtttgaattatgttcttcataattactaaatttttctgggcatcaaatgctccccttgtattttttcgtttttttcttctctatcttgtttttcctgtctcattcttgaaaatattctctcatatgctctataaagcccatgctatttttgcaaaatcaattactgatggctttctagcttttagttttaatccttcagaaggcccagaagtttctgtcacgtatacaggttcaagaacttgcttcaatatccttaaaaaacattaacatcttaaggaagttttaatgcaaaacaaatggaaatagctttgaataagatgtctgtttaactaatgtcatctaagctgacttttttgaacagaagagtaaataagtgatatccttattattaagagactcccttaagggccagtgagaggcaggaaaacatgaaaccacagtgagtattagaaaataaattgcagttttgggcctccaaacacaatgtgttttttatattatgcttatgacacatctagttattctgaaaaccggccatgtgttttggagcagaagcatttccactgaagatggtaattgcttatgagtagccattgatacatgaacagtgaacatgtacctaaaccactgtgcattaataagactttcttcgcttgcatatgaagagaccccaatcaagaaagtttaatgatataagcagagttattggctgatatgacccagaaagccagaaatatcctggcttcagatacggctggatccaggagctccaatagtattttttgaactgctcattctttcttgcataggatttctctcttgagacaaagtagccaccaaagttatgtgattgtaactaaacaatctaagtagaaagaagtaatattttgatagctccagaagaaaatgtacaatagggcatttcattacccccaattatacctatgcccatctctaactaactgctattgtcatgaacactacatgaacaggattgttcagaaaagagaaactgttattaaaggagagacaacttctgaaagaaaaaaaaagggccaaaaagctataaagcttcactcttttccctcttcccaatggttaattcttagattaactcctttggtgcatttctctaatacatttttataactggatttgaagttagatagtcccctacccacaatgtacataggatttttccaacccattttaggaggccatcatcccataggcacaataaatacacaaactaattaagtaattatttaaaaacaataaaatccatattagctcttaccttctctacaaatacaatgctgatttgcgtctaccaaagctaagcatgttgagttgtttctgcaagggttatgaagtaggtcacaaaggttatagcgttggtggcaaaattgtccagtataaaggggtgggcacagacatacaaattgtccagggatggtagattcatgacaaagacctccattcatgcatggatcagagtcgcattcatttatttcttcactacagttctgtccagtccatccagatgtacactcacatctgaaataaaatattaaaatttttagaagtgtgaactctttttcaagtttattttttgtatttttaattactcccttgaactaatagtatgtggtgcttttaaatttataacaggactaataaataatacatagttttaaaatattgtttgcctaatttcctgtgacagtataatatatattaccataaaacttaccaccttggctgaaataagattttaaaagcattaacaaatttctaacatagttaggcctctgagacatgtcagagaacaactattgacctaaatcaccaattgagcaaaattttcctatgaattatttaatataagttttacagatgagatcactatttataagccttaaatgctatttaattcagcgtccttagcaatatgtgaaattcttgtcatcaccagagtatataacaaggtgttactttatgttaagcatctgtttttggctttgtgtgtgtgttgaatcacttgaaatgcatttttaaaaatatattttcttttttaaaaattttagattcagggcttacatgtgcaggtttgtaacacagatacattgcataatgctgtagtttgggcttttgttgaacccattgcccaaatagtgaacacagaacccaataaatagattttcaacccctacctttctccttccctgctcacttttggagttctcagcctctattgtttccatctttatgtccatgtatacccattgtttagcttccacttgcaagtgagaaaatatgatattagattttctgtttctgcattaattcactaaggataatagcctctagctgcatccatattgctgcaaaggacatgatttaattcttttcatggttttgtaggattccacagtgtatatgcatcacatattctttatccagtccaccgttgatagacagctacgttggttccatgattttgctcttgtgaatagcactatgataaacatatgagtgaagttgtctttttggtagaatgacttctttttatttgggtggatgctcattagtgggatttttgggtcaaatggtagttctatttttagttctttgagaaatctccataatgctttctgtgggctgaactaaattcgtattaatatttgaataatgtgcgataattgaagggaaagcaaacaaataaaaaataaagcatttggaagttatctgtgtatcacaggcttctagctcagtctagtcctccatccagtatctgtcattatcttcaaataccactttggctagtcatcatccatgaaacgaggctagtctgccgtgaagagaaaaattctagcagacaggagggggaaagtgttttacacacaaaattctagcagacaggagggggaaagggttttacacacaaagtgtccatttgagggaaatggaaaggttatagtgaagcctgcagatagagagtaaatgcaaatagagagatagagaggtagtccatcagctgggtaagtggaaaacaatcacaaactgtaggtgtgttcaaggagagaacttgtgtcaatttgtgggcaaggtagatttccaaatcttgagcaactttactattatgcaagttatgaatcatgaaacaagcacaggaaatattagaacaattattttcaaaaagtgtatttactgatagattagatttttaagataacttgaaaaaagtcatagtgctgaaataatgtaacttactttgtgatacagaatatcttactaaaaggaggggagcaaagaggaaggaaagaaggaagaaacaaagaaaagagtcacctaatttgcagtttcaaagccccagatatatcaaggccctttataattataaatacataggataccaatatattggaggagataattgaacaaatgacttgcaacaacatctataattgaattctaaatcgatatagttaccattaaaataaaaaccaaaatgaataattggcaaaatggtattagacataattgactaataaagtgtttactagttcaataagtttaaatccaatgcattgtaagccagtggatttcacagctgtctaaatttttttttaattggctgtgggtagaaagtaattgctatcatgataattgcacatttctttgtgaagcatgctagcacaagacaaaatttatgactgaaacaattcataccttcacaatataaaaaatatatacctaagggtatgttatttacttaatattttattttcttctcaaaatcaaaatgctctaattattttggtgactttccatcctagtttgcctggagagacttggttcagtttgttgttctgatataattttcagggcatccttttacttataaaagtttctaaggtgctttttttaaaaatctttatctcctatatcccattactgaaattgagtatctaaaaaacaaaacaaaacaaacaactatacacttacctatttactaatcctacaaattatttcactttgctctaaaatttgcttgccatacactttaggaactcatcatatatactatcttgtgttaaaatcatttgcatggtttgcctccaccattaaacttctggttcctgaatgtctaagaatgatctgaatctccacattatcatgtcaacacaataaatgttgacaatactataagaattgatataaggtcctcagtgttgaaacagatcaacttatctgcactctttcatttaggaagttgaggatcagagagtttaatgaaattggtaatctcagagaattgttgtaaagattacatgacatgatgaataaaaagtatatatagtgcctggaatctgcattgcctggccacctacactgtttactagatgctgtcacagaagttttaagaatacattttctgacctatgagcctaaatacaatgtgtatctcagcaatgaatatttctttagcttttagtagtacttctttttaatgtttgatcatcacatcacattttaaaattgtcaaatatattatccaatttgatactttcaataaagctttgaaatatgtagaagagatattctttttctcactttacagatgagataggtggaagttcaaaggataacagtgatgtatcctaagtcatgtggttaagcaaatggaacttagaatccagatctcctcctctcaagttcctgtttttcttttcttttctttttttaaacatgctttaaatctagtatcatttctttaaacattttgtgaaataatgttaaaattgggtattacccagtcttaagagaacttcagtgtatttattttgcttgaaataacatcactgtaaatataactattcagtcatataatgggactcagttaatatactatggcaattttaagaggagaaaagctagagaattaatattttctaaaatcatggttacacaggtcctgagggtattgcacaagtatttatgtttttctctttattgtattctgagtacataatttcaacttggttaatttaaaagagtttcctaagaaaaaccgacaattcttgcctatttggcatatgtgctgaaggtttgttttatcttctcacataacaggtggcctaagacctcatgtggtgtcattccaaggatccaatcctcaggaaagaatgtggctgtatgtcaagaggactgataatgccaaggctgagttctatggagataacatggatgttttatagaaaataaagttccgaggaacaaagtcactactagtgactaacaatcatacctacaggtttacatatttgaatctgcttccgcacatgtcagagaagctagtgtttgatgggtgggaaaaggaaaacatatttgatgtgagggcttcaatcagattctaagtttgctccatgaaataatttcaggatttagtggaaccaggcagatattttcaaactcacagctagaagcagagtctttatggattaaaaaaaaaatgcaaagcacataccgtgtgactttttgagtgtacaatttctggtagtaaacacttgaaaacaagtaagtgcgtgcctaaagataggttaatacattctaatttgctcttttccctagtgtgagaaaatctaaattcattggtgtaaaatacattgaacacttctaaggacaacttttcaaatcttaaatgctgatttaaagtactaaagctgataatagaaaataaagtagttatcatcgttaaaaagtggaagaaatactactcattaaggtgcgttggctcacgcctgtaatcccagcactttgggagtccgaggcgggtggatcacgaggtcaggaaatcaagaccatcctggtcaatatggtgaaaccctgtctctactaaaaatacaaaaattacccaggcgtggcagcacgcgcctgtagccccagctacgcgggaggctgaagcaggagaattgcttgaacctgggtggcggaggctgcagtgagcagagatcgtgccactgcattccagcctgggtgacagagcgagacttagtctcaaaaaaaaaaaaaacaaaattcactagcttcaaaaatcttaataaatgtcaatttctaatgactaagcattctatatgtttaccttaccataaacatttatttgtaatgacaaaggatcgttcagcaatatgtatctgtgtttgaatatattttgtatattaaggcatataggcttttttggctctaaatttattaatacaaacctaagtgtatatgcagtttaaaagaatattttcttataaaaatcagttcacttctcttagaagcaaacagtaaaatgttgtttatcagctactgggaggtggaggagatcagtggagatgttggtcacaggatacagttagatggaaggaaaaagttcaacaaaccaattgtacatgatcatgactatcattaataacaagatattgtgcacttaaaattttttaagagagattttaagtgctttcttcatgaaaaagataactatgtgaagtaatgcatatgttaattagcttgatttacccatttcaaaatgtatgcatatatcaaaacattatgttatacaacataaatatacacaatttttatgtgttaattttaaaaattagttcattatttcctgcaatcattacatatttgaaacacaaaatttcaaccaaaactgctaggtgaaaaagaaataatgaccgttaataataaaatagtattgttatctttttagtgtcctacaaattggggacataggaaagggaagaattttttttaatgagctaccgaattaaataattcattcattattttattgttttgtctattaacctatttacacccttaggtgtacataccatcaacaaaattatattcataccgaattataacatgaacattactaaactcttaacctctgcaatcttcttcttggaaataaatgtggaaaatcacttagctcatttagacggaaaaatctattgtaaaaaatatttgtaaacattaaaaatagaatacaaaattaaggaccactttgaataacagcctgaaaatgttagtatgtaaaaacatatgagaagattgatatgggtaaaatgaaagtgaggaggtagcctaaaaacagtaatagcaaggcaaagttgctgaggattgtgaaaactactgcaacaacaagaaaagtaaaattaaggaattttgactttacccttgaagatatttaagggttttttgtttgtttgttcgtttgtttgtttctaagcctgggagtaacattgattgttatccagtagatggattaacatagggacagcttggaagcatgaagatcatttaggaagctattgtttcattactgataagagattatgagtactacacaaagggagtaataaagtacatcaaatttgagatatatttctgatgtaggacagagaagatttggataatggttagtaagcagatgaggcagagtgaggagtgaggactcagtgggcttcacattcactattggaaagataatgatgccatcaggtaggagacagatgacaacgatggaaatagaagaaaataagatggcactgatgcttaatatgtaacaacttaaatcaaataaattgcatgatttcagatgctgtcctgcatgtattgaaaattcaaatatggagctctagaaaaaccaaggcatgcaataaaaattcaagtaccattctaacaaataatactaggaataaataaatttaaatttggccttctctgctgaaatataaatttatgaaacatatagaatcctcttcattatgatattctgcagtattttatagaatcttaggtacatatgtagattctttgaaaagaaataggcaggaaagagttctactaggcagattagagtaagcatgtggtcggatagacagtaagcaagatagatagtaagcaaacctttctttctttaatttttatttatttattttgagatggagtctcactctgtcgcccaggctggagtgcagtggcgcgttctcggctcactgcaacttctgctgcccgggttcaagcgattctcctgcctcagcctctcaagtagctgggattacagccctgccatcgcacccggctattttttgtatttttagtagaaacagggtttcaccatgttggtcaggctgggcaaaccttccttttttatgtttttctttttttcttttttttttttttgtgaggctgaagtttatggagtatgtattctaaatgaactcaagaatttctgttttaatattaatagaaaaaggatttcttctatttaggccatcaagcatcatttcatatattttttcaaaaaaataaattcagacatataatttatttatacacataatttataagtcaattatttcaattggaagaattataatctatatttttcatacattttgatgtaaatgaactgtatggataattccttgatataattctcttcaaattatctgtttccaatattctatatgatttaatctcctgtgccatgtaaaaagacaactggtcaataatctttttcagagttatttaattcaagctgctttgtaggtcagtatttctaaaaaacaattcaaggctttttcaagattcagaatattcctcgtttcatagaagaaagctaaaatgccagacaagcagaggcagataatgcattgggtcacgcctccagtatattcatatttaaaatctgaggtaaatctgatggaactcatgctgtattttgaagaatacccaaagttaaatacatttgaatctgggactagaacagcaaagccaaacatatgccgtacagtgagatgccatatagtgagattagtttcattttttttttttgtcattgtggtcataatacagaaaccatgagaatggggtattttaccacttggatgatcagaatttagatttttttgtaagcctacaacaagccctaagacatttatgttgaaagatgaatctttcaacaacatcttgaataaagctgaaagacaacacttgctcaaaaaggctgactacataagatagttgaagctactattctgtaagtttacctgttgagtcaagaaaatgactagtgttataaacatgagtaacatgaacaattatgtgatttagctttgaacataaacctagtttaagttactgtctttaatttcttctattttatttttccttaatggtgtgtgtgtgtaagcggaaaattgatgatgaatcagtttctgagcaagtaagtattacttctggctcctgtttttttccaaaaaggatctttgtagcaagtccaagtaagtctgcttttaaatataatgctttatatattcagaagaattcatagttgcatctttttcaatgcttaaaaatgtatgtaagtatatgtctgcatgtgtatatgcaagtataatatccatacctatacccacacattgtattcaaattatacttgaaaatgcatatataatctttcaaatacagtttaaaatgtataaagatcctatatacctacacatatatttttattctttcaggtacaatttgagtaggaggcagaattttaaatacaaaagcaggatacagagtgttacataagcaaagtactaagatatagaacttaaacaaatttataaacattttacaaaataattcataaatcttcagcatgtcaggtgtttcatatggagaaacattttaaactcccagtttaataagcattacacttgaagtctcagaagaaaatcaactgagctagcaaaagccaaaggatttttatgcatatggaaatattacaagcaatgaggaaacaaaatagtctttgtttttttgttaggactggcattataataaatgctatatctgtttcatactccttaggggtaacatgtattaaaactatatactctaattactaatcacacatacttagttcagactatatgcatataacaccattaattctgaaatgtaacataaattcagttagccgatgtaaaaatatgcaaaaataaacctattgaaaatgaacactaacatatctttccacatacagaattattaacccattattttattaaaatttaaaattatagaacatgtccttccttaaaaatttaaataacactcaaattgtcttattttttaataaaacagatggaactatagaaataaataaggatagcagagataagagagaaatggaaagaaggaaagagaagcaaaataattattttttaaaatgtcactaaagggtcacctgtctcacaggggttatgtggaaagtttattatctatgatcctgcttcttgatgagactcttcctggtacttagtcaagccggagtccaagtgatattcaaaaagcctttaaaattcactaagccagaacttcaaactcatggaaagaaaggataaattcaaagtagaagagatttatctttgtaaagtatgaagtaaagtcaccagtgcctgtgtctctctgaatctaactcaatgtgacaaagaaaattagaaacagaaaataaaacttcatcctcaataaaacagttatcaataatcccaagccaaagcacaaaagaattagatgacaaatattgtgaaaggaccaagataagagcagatatgaagagcaggtaggtgcctgctgctggagtaagccagcagaaagggcacaaaaatagttctcagagtaggaaactgatgaaaaattttaaaaaacaagaacaaaaattaaaaaaaaaaacttgcttgaaatataaggctgggccaattttccatcaaagagtgtttggggtagaagaaaagacactggcagaatttggaatttcagagacatgcaacattgagggcccatgaaggaaaatcagcagtcctgttgctactgttattcactggggtgacgaaaaataaatccattctccctctctcccacctctgtcacacacatacacatgcatatgcatatatgtgttcacacacaagcaattgaaaaaccaatattttcctctgagccagggaagattctgcttgtttctcattgacaaggacattgtgttgactcacacacattcccacaaatactaaggttttgaagaactaaatttaaagataagaaaaacttagaaaggaattagtgcaaaatagactgttgtgtttgtgtgcaaatgtaaatgtaaaaataaatgagtatgaaaagagccagacatcttatataagtattattttaccaagcatattaaaattacagctagataattttaagacaagtataaatattactatacaacaaaatatttaaggagatataaaagactcaggatatatattagttaataaaatgagaggaatcccaatggcagaattccagaaaaaatagaggataaattaaatgccagtattcactggcccttttgtttcctctccatgatagcagtgcaaatgcactgcttctagtctgccatcttgacccaacatccctttaaatgtattttctaactcattccctagcttctagggtgtcctggcatcttagctatggatatcccagtacctgcaggtcacaaggtaacagagactatgacagtcatctgggtctcctggaacggaggacacagagcagtggagatggaccccaagctctaggtggagtaagagacctactttgaattctttatccagcatcccaacatttcattttgtttaggattcaagatccagtattactatgctgatttttttctcatctggagaaacacttcttactcttgtttactttttttggggtgggacttttcttgaggatgtgcctatgatgtatgttgagtaaggccatttggctttgcttctgggtatgtttagtggctgtattagtctgttttcacgctgctgataaagacatactagacacgggggaaaaaaaggtttcattggacttacagctccacatggctaaagaggcctcagaatcatgatgggaggcgaaaggtatgtcttacatggtggtggcaagagaaaaataaggaagaagcaaaaggaaaaacccctgacaaacccatcagatcccatgagacttaatgactatcacgagaatagcacaggaaagacctgcctccatgattcaattacctccccctgggtcccttccataacatgtgggaattctgggatatacaattcaagttgagatttggatggggatatagtcaaaccatatcatttcacccatggcccttccaaatctcatgtcctcacatttcaaaaccaatcatgtgttcctaacagtccctcaaagtcttaactcatttcagcattaactcaaaagtccaaattctcatctgagacaaggcaagtcccttccacctatgtgtctgtaaaatcaaaagcaagatagttatttcctagatacagtgggggtacaggtattgggtaagtacagctgttccaaatgggagaaattggccaaaacaaaggggttacagggcccatgcaagttcaaaatccagcgaggcaatcaaattttaaagctccaaaatgatctcctttgactccatgtctcacatccatgtcacactggtgcaagaggtaagttctcatggtgttgggcagctctgcccctgtggctttgcagggtacagcccccctcctggctgctttcacaggctggcattgtctgtggcttttccaggcacatggtgcaagctgtcagaggatctaccattctggggtctggaggatagtggccctcttctcacagctccactaggtggtgccccagtagggactctgtgtggggactctgaccccacatttcccttccacaatgccctagcagaggttctccatgaggaccccgccccttcagcaaattttgcctgggcatccaggcgattccatacatcttctgaaatctaggcagaggttcccaaacctcagttcttgacttctgtgcccccagaggctcaccaccatgtggaagctgccaaggcttagggcttccaccctctgaagccacagcccaagctgtactttggtcactttcagctatggatggagcatctgggacacagggcaccaagtccctaggctgcacacagtatggtgaccctgggcccagcccacaaaaccattttttgctcctgggactccagggctgtgatgggaggggatgctgtgaaggtctctggcatggcctgcagacattttccccatggtcttcggcattaacattaggctccttgctacttatgcaaatttctgcagccagtttgaatttctccccagaaaaagggttttttcttttctattgcatagtcaggctgcaaattttccaaattattatgctctgcttcccttataaaactgaatgcctttaacagtacccaagtcacctcttgaatgccttgctgcttagaaatttctactgtcagataccctaaatcatcattctcaaattcaaagttccacaaatctctagggcaggggcaaaattccaccagtctctttgctaaaacataacaagagtcaccttttctccagttcccaacaagttcttcatctccatctgagaccactgcagcctggaccttattgtccatatcactatcagcatttggggcaaagccattcaacaagactctaggaagttcaaaacgttcccacattttcctgtcttcttctgagccctccaaactgttccaacctctgactattacccagttccaaagtcacttccacgtttttgggtatcttttcagcagcaccccattctactggtaccatttactgtattagttcattttcatgctgctgataaagatatacccgagactgggaagaaaaagaggcttaattggatttatagttctacatggctgggcaggcctaagaaagaatcatggtgggagatgaaagccacttcttacatggtagtggcaagagaataatgaggaagaagcaaaagcgaaaacccctggtaaacccgtcagatctcatgagacttaatcactatcacaagaatagtgcgggaaagaccagacctcatgattcaattacctccccctgggtccctcccacaatacatgggaattctgggtgatacaattcaagttgagatttggatggggcacaaccaaactctatcagtggaatagactctgtatgatttctttggttatacgtagtcttcatgtggtggcttctcaaatgctcattgtggtagcgatgtgcctggtgtgtcagcaggcccaaggcctcctaatgagcaagggtggtgtgaataatagtggtagcagaggtcatatgaggctaccttcccaaatgctgtgtacttgtgtcagcagatactgaaatgggctatgaagtagatcttaaggccagaaagtggtgcttataggtgagagccagatggcatggtcactagctctctcctgtaagatgttctcaccttgtctagatgatctctcatctacacccaaaggtgtaatctaaatgaagttctcaggttcccaggtggtgggttgggttgtagaacattcagtggtccttgtcccccactttgcctctgaggacagaggcagcatagctgggaactgggccaagcgagcctgcatgtgggcccctaatggtgggtgcaagcaccagccccagtagggttcggagtcagttctcgggtccctagaataacttcccaatgaggagcagaataatcattgctgggcctaagacccaggatggggaatgagagatggctcaggctctacagactagcaagtggtagtgggacctgctgtgctctcgtactcccaacctaggagggctccctcctatagtctgactctggcagaaacttagaacagttagccaaagcactcctagtttgccttcaggcagacctatcccaggccacaaaactttctgctggggtcaaaaccacacccactcatgtcctctgaagagggagcacccaagtactgtgcctgtggctggagcacataccacatttgcctctcaattctagccccaggggcttctcccctgctcaagatcataaatctctgacctgagactctccagaccagtaactgccacttgtgctggctggcaggtttccacatagctccctatgagctaggatacagaatggcctcattctattgatgcccagttctaggagagcatgcaggataatttctagggctgttcctgctcatagacttctgatggctccccaggttagatccagagcttggttgggacaaggatctccgttatagcctggattgcccagcttcccagtgggaatgtgcatcatggaggcaatcactctctatctcatgcactggggattcactcacaattttctgctggagcctgccacatgagttgttacctgcattttttttctaagtgcccaaagttttctttaactcttatgttgatctcccgtgttcctttttgcacagaagttcacagtgtgaatctttacacacaattttgctatttctaagtaggtgaggtatactaacaaagcctccaattacccatctggtgaaagaaaggtgtttaaaaactttgaaaaagagatagaccctaaaatgtaggtatttgtaaagaattcctataccaagacatacgttaattgtgatttactgtgaaaagcaagagcaaatataaagactatacaggcgatatacgtcatgatttttttacaaaagaaagcagagttatattttctcattctgaagtcaaagaagaattttatagctgaatcttttagtataggacattgggaaacatgatggaccatgtcttgatgtatggctttgcaataggtatagaaatgttcaaatgcacatcttttaaactgattctgcatgaaaattgaaggcaaaatgtaacatgctaactttgtgtggaaaaaaaaggattattagctcgaataatgtgctctagacacagatctaggagaaacacataaaatggattccttagttttatgtgagctctttttgtttgtcagctggcttatcattttgaaagctgatagttactcggggcatgcattggaaatacccacagattattgagcaaaacaacattgatctgagaagaaagccctctacaagaaaagaaatatccctaaatcaaactagcaatacgaaatcttacttacctagaaatacactaataaaagttattgattacttacgtgatcaattctatagactgaaacaatttagaataacaaatacagaaataaaactttttaccattaaatttatgtcaaaactccccagcataagaaaaaccacaacactgaacaaccctttcatcactgatttggcaaggagttacaggtgacaataaaaaataatgtcaaatcttaagggttctggtgtaagaagtcctaaattctatatctcttctgctaataacatgtcatttgaaaagccaactgatctatataatttttttatatcctcatataagaaacaaacataaataatatcagtatatcatctggccatagttataataaaagtcaaattaaaagtttctatgaaacccctttattaagataaacatagtaaatagataatttaatttacatttaaagatttctcatgctgaaaaaaagtatcgatgttttgaaatagtttatcagaaattattacaaaaggaaaattttcaaaagcccaacaaatagggtataagagggtggaaatgaactgtgaatggggcacaagaaaactttctagggtgatggataagttctatattttgggttcagtggtagttacacaagtaagtgcaattgccaaaactccttaaattgtatatgtaaaatctttgcattttattatgtgtaatcacaataaaaaatgtccaaaagctattgaataccttatgaaaagtctatttctctaaaaacattgcctcccccttccccataaaaagaaagagtaagggaaaaagtctacttcaaaacataagaaaaatgcaggaccttaattatatcatttttttaagaacttaatatcaaattttgattatctttcaaaaaaagaaaatacagattttgcagcaaataatattctcatgtacatttttcctttatttccatatgtgattacctttcttccacagttcaatacaaataattttactcacaaataccataatcctaaatttcacattttgtgtttgttatagtcatggtcattgccctcccatgcaacattgaatctgaaacaaacagtaactaatggctttcaattcatttctaatgagccattgctgaatatgtctgcatcattctggttttgtttcatggtattatgtttttacatttttcttaaattttacagtttctagtactttgcattaaaacaattcatcatctttaaaaacaaatgttaaaaaagaagaaaacaagcaaaatctattcttagatatagtactttttaaaagtccatttttttttaattttagtttatttttaattgacaaataataaggcaacacttttaatctgaacctggtattatggttctatgtgaaataatgagataacctaatacggaatgatttttttctaactacacctctaaacaagcaaaattatctttgaatatgtttctatgcagttctgtgaataaaatttaaagattttatgtatggctatgctaaattataatcttctgggcttcaataaccgtaagatatgttttcataactgcactcaggagacatcagaaggtgttggggttgaattgtatctccccaaaagaccttgaggtcctaatcaccaggatctcaaaatgtggccttttttgaaaatagagtatttacagtgatattcaaatgaaagtgaatccattagggtggaaactaattcaataggaccactgtcttttaaaaaggggggaaattttgacacagagataggccctcacacaggaagaaaactacaaaaattgaaggctgagatgagggtgattcttcagaagccaagggatgccaaagattgtcccggcaaagtaatacagaaggtatacagggagctttttacaattactatgatgcctgataaaactgtctcttcctccattctttcaactcagttttggtgaaataagagagttcatttattcattcaaaataaggtctttaataccttttctgtttatcactgcctgtcttcaaataatatgccacttcctgtaaaacataatagccttacaacaagatactgtgctttccccttttcttcctttgtgctactgttatcaaaaagcaattttacttaatcagttagttctaaggcctatttgtacaataattatttgaccaataattggtggtaggatgtatttatctgtcaaagaaagtatacttaactcctgagttactcctttttgataaaatttgaactacatgaggttccaacttttccagtgagaaaataataattatttagtctttcacaaatttgttaaaccttgggaactgagagatatcatacatatcaacatatgttgccactggcaacgtatgtatgattatatactataagcaggatcagatgatgatgatctcaaaccattgatgtggagtcacacctgtcttgttctggtatttagatttactactttttaacactgtgatttctgcataagttacggaaaatatctaagtttttgttctttcatatataaaataaacataaataaaatctgactaagagatttgctcaagaacaaaatgatacaaactgtaagtgtctgctatagataattgctttaattacttgtgtgaatttactgaatctgtccaaaagataatttgataaaaactactcgaatatttaatgtagacacactttgatccagcaattacacttatagtaatttattctacaaataaacatgcacacatatatacagaggcatatataattcctcaaataatagattataattgtaaaatattaaaaattccctgtgtctgttatatctgtaaactacagtgtagctataccataagaggatgagtgatctacctacccacacatattttgttcaaacctccggtttttgtgaaggaaaaatcttttaactcttaaagatagatattgtgccatagattgctattgcctgaactaaaattttgtcatggctttgcttttatattagcacttaggacttctatgcataaataaggtaaaaaaaaaaaaaaaaaaaaagcaaaacaatatctctggtaacacattaaaactttcatagtttttatttgatgtgttaagatatacataaataatcacaagtttttaacttattaaatgtcagactttttcagttattatatccattaaaaatttttaaacatttttataagagatgaaaattttaatgcatagtgcttcatgatttaaggtatttatttaaatactcataaaagacaaactaaggaaaaaaatgcttacagtcatctgggagcaaaccttcacgttgtctgaaagtcagctttgtagtgtccataagaaaagcaggccaaagcatcaacacaaatgccaactgcacaggcagcaaagagccagatgctgttggcaaaacatgctccagagtgtggcatctgggtccaataatggccatacagagccccatctgtagctaaagctgttgactctgctttgggggaagaaaaatcagaaataaagaaggcagttaaattttaaaccatgccaggaatagcagaaggcaggttgcagtcagcattcaaattacatcgctagcccaatttgctttttaatgtcttgaaactgtgtaaacactaaactatgttaactccagttgtttagagagatgagcacatataggtagttcagtaacttaggacacacaaatcagctaaatagatttgatattccatcagacgttcatttatctaatttttttctcaaggaatataagcatatggtccatgaaatgcaattctaatttgatctattaaaatatgcaattttaagtgttcattatggtatataattttcttcaaatagcataaaatttaagactcttctttacaatgtttataatattttattagaataactcttcacaaagttaaataggatattcatgtatccttcactgagactccttaaagttttgatcagtggaaatttgtgggaaagctacaaagaaccttaagctttaatcaaataaagtttttcaaaattataaagagatgatcaaaataatctctttttagtgttcttcatttgttgtacatataaatatataaaatggaattagttgatatccagatgattaaaaagattcatcatttataagatgccacactaatcttatctatgcatatatttttgaaaacaagatcaatgttttaaataataaaaactaatgatatttacagtgaactatatataaaaaagttaactaaaactttgtggacagaatattatttatcaccataaccctgagacattactattgttgattctactttctagctaaggaaactggaagcttgcaaatgtaatgtaaacttacttatcccaattcacacaaacccttagagacagaatcaaacttaatatgcagacactgcagacactgtgattgtagaacccatatttattctccttctccccaataagatgaaaataaaatataacttgatagaatcatttctgtaatagcagaggaagaactagtcaaacatacactcttccataaaagaaacttgtacattgataaatatagttaaaataagctgtttcagaactgtgtaaatgaactaaaggcttgaaacaatctccgtgtttattcaagaaaaatgattgaatctcataagcctaatcagcttcgtggttgtaaacaaccatccctctctccccagctcttcaatggacttgaaatccaatatcattgcaataatggtagctgagaaaccagcaacctaatagccagtggagggggaggggatagtacaggtatgcatttgactcaaaagacccttcccaaggaatgtcactatttcattggtttgacagcactctgaaaaactccattctcagggactgactttatttgacctgactaaaaattcactcttataaaaaaccatatatctagggaatttgttaaaaataatcagtggcaattgcttaatatcacagtgtttgaggcaataattccagttgagggcaactctaggttgatcaatataatcaaagatttaataactcgggaattagatgtacctagaagtctttgaaagctagaaaaaatcctggaaaactagaaaacatcacagcatgcaagtctataaacaggcctaagaaagatataaacagccctaatctctgatctctgactaaccttgaggctctatacaagcaggaagtaaagaataaagtacagttgtaaactgcctggctgagcattgaagacatgtctcaacacacacacagagtcctttagtaaaggctggaagatgttttagttccaaaaatctaagaaaaatctctgtgaaatgattcattttagctgaccactaagttaatcaagcagagactaaaatggccacacatggtaaagaacaatcccagtgaaacactagacaaatagtagaaacaacaaaaacaaaaacactagctactaggaaagagcaagatttgatttccagatgtaccaagttatgctatttaaaatgtcaagttaccagaaaatattataagacatacaaagaaataaaagtatgggccatgcacagaaataaaaccagtaaatagaaactgcctttgaggacacccgaatattggatttacttgacaaatatattaagtcagctatggtaaacttgttcaaagggaaatataaactattatataatcaattaaggaaagtaggagattgatgtcttaccaaatcagtaataaaaataaaggaagcaattattaaaaaattaaaaaacaaatagaatttccagagttggaaattataaaaactgaaaaacaaatgtaaaagagaaaaacaacgtcatcaaaaagtgggcaaaggataggaacagatacttctcaaaaggagacatttatgtggccaacaaacatatgaaaaaaagcttatcatcaccggtcattagagaaatgcaaatcaaaaccacaatgagataccatttcacgccagttagaatggcaatcattaaaaatcagtaaacaacagatgctggagaggatgtggagaaataggaatgcttttacactgttggtgggagtgtaaattagttgcaccactgtggaagacagtgtggcgattcctcaaggatctagaactaaaaataccatttgagccagcaatcccattactgggtatatacctgaaggattataaatcattctactataaaaacacatccacacgtatgtttattgcaacactgttcacaaagcaaagacttggaaccaatccaaatgcccaccaatgatagattggataaggaaaatgtggcacatatacagcatgaaatactctgcagctataaaaaaggatgagtttatgtcctttgcagagacatggatgaaaatggaaaccatcattatcagcaaaccaacacaggaacagaaaaccaaacactgcatgttctcactcgtaagtgggagttcaacaatgagcacacagggaggggaacatcacacaccagggcctgttggggggtcagggggatagtggagggatagcattagaagaaatacctaatgtaaatgatgggttgatgggtgcagtaaaccaccatggcatgtgtatggcacatgtagacctatgtaaaaaacctgcacattctgtacatgtatcccagaacttaaagtatattaaaaaaaaaaagttattggaaaaaataaaataattactaactgagcaaaacaagagacttaatttggcagaagaaagaagtagtgaacataaagataagtttattaagataattgtgtctgaggatcatcagaaaaaaaataaataaatgagtagatcctcagagatctactcacatatgagttccaaaaggaaaagggatagataaatgctttgaaaaattaatggccaaaactttctgaatattatgaacaaatgttgatctatacatccatgaacctcatcaaactcaaagtagaataaattgaaagagattgaaagttaatcatgatagtcaaactgtaaaacacaaagagataatagtgatagcatcaagaaagaaagtgatttattacatacaaggatcctcataagaataacaattgacttcccatcagaagccaccatgtagataagaaagcagcagaatgatatatttgaagtgctaaaagaaaaaaaaagactatcaaccatgaattctatatcctacaatgctaccttctaaattaaagcagaaactaagacattttcagataaacaagaacaggaagatttcataactagcagactaacatataaagaatagtaatgatagtcctttaggttaaaatgaaaagaaactatagaatcttaattattcacacataaaaatcatgagatccagtaatggtaactatattagtaaatattaaaaccagtataaatatgttttgttcataactcttttctctgtatatgatttaaaagatggagcataaaaccataattataacagtttgttgatgggcttataatgtataagatataatttgtatcacaataataaaacaagggagtaaaaaaaggggagcaatggtggagcaatatttttgcacagtgttaaaaataagttgctattaatgctgtgtaattgctttatcttaagaggttacttataatctataggtcaaccattaaaaattttctaaataatacaataaatgtaacaagggtgttaaagtggtatatcagaaaaaaatatctatttaacacaaagtaaggcaataatggaagaaggcagcagcaaaagagaagaagacatatagaaaacaaatggcataatagcagaagtaaactctaccttatcagtaattacagtaagtgcaaattgagtgaacattccaatcaaaagacaaataatggcagaatgtgcttaatgaaaaaattgttcaactatatgctatttgtaatagttatactttgtattcaatagtgaaaactaaattcatagcaaaaggaaggagaacataatgaaaattaaagcataaattaataaagcagagaataaaaaagcaatagaataacacaatgaaatctaaaactggtactttccaaaactgaaaaaccattaactagaatgatcaagaaaaaacagagaagacccagattacaagaatcagaaatgaaagagaagaaaatactacactcttccaaaaacaaaaaaggattcaaagagaatactaaacaattacacgctaaccaattataaaggctaaatgaaatagataactttacagaaaggtaaaaccacggaaagtaacccaaaaaaagtatagcatatcaataaacttacaataagcaaagagatttagtaataaaaatgtgttccacaaaataagtacatgagtagattgctttaccagtgactttaccaaatgtttacagaataatgaacaccaatccttctgcaactgttccaaaagagaaggggaaaattcttaacatgttctatgtggctaatattacccagtctaaatccagtcaaagatatgacaaaaaaagaaaaatacagatcaatatgccttaggaatacagaccccaaattccttcatgaagtactagcaaatggaattcagcaacatatacaaagaaatatacattatgaccaattgggacatatattagttctgcaaggttggttttaaaatagaaaaccactaaatgcaatatacaatattaatagaatataagacaaattacacatataaacagcttcattgacagcatttgaaaacattcaacacattttataaaaaacaaaacaaaaaaaacactcaacaaaccagaaacaggagggaatgtccaaaatctggtaaagtgtcccatgaaaaatctacagctaacatcatactttatggtgaaagactgcttgattttcttttaagctcaggaacaagacaagcatatttagtctgtcatttctaagttcaacattgtactggaagttgttgggataattaaacataaaacagaaaaaaacgtatcaatattggacaggtaggagcaaaattgtctccattatcagatattaaaaatcctaaggaatcgaccaaaaattattataactaataaataagtttactgatgttgaaaaatacatcatcaatatacaaaaatcagtgctgtctctatacactagcaaagaacaatctgaaaatggcatgaagacaattccatttctaataacataaaaagattcaaattcttaagaatagattctaagaagtacaagtatacataggaaacaataaaatattattgaaagaaattaaagaagattcaataaaatctctattaaagttatggctgccattttcttcagaaagtaacaagctgatactaaaattcatatggaagtacaaggatcccagtttagcaaaacaatgatggaacaaaaaaataagttggattcatatttcctgacttcaaacttaccaaaagctacaataagagggtgtggtattagaataaagataaatagaatagagggtctagaaatccttacaagtttgtctaattcatgttaaagttaccaagataatttaatatggaaagaatagtatttttaagaaattatcctgagacaactggatattcatgtgtagaagaatgaggctagacctttacctcacaccacacacataaaaattaactaactcaaaatggattatatctcaatataagagctaaaaatataaagtttatagaagaaaatacagaaataaaattattgtaatcttcagttagacaacaatttcttagctatgatatgaaaagcaaaagtggcaaaagaaaatgagtcaattggttgtcctcaaaattaaaattgtttgtgcctgaaaggacaccatgaagaaaaagataactcacataatggaagaaaatatttgcaaatcatatttgataattggcttgtatccaaaatatataaaatttcttacaactaagataaaaggtacataacttccattcccaaatgagcaaatgatatgaggagatattctcccaaaaagagatacacgaggtcagaaagcacatgttaagatgagctgtattattagtccttagggagatgaaaatcaaatgtgcattgaaataccatttcacacctactagaagggttaaaaagacaaacatcaacaaatattggcaagatgtggagaagttgacactctcatacactgctggtggtactgcaaaaattatacattcactttggaaaagagtttggaagttcctctaaaagttaagcacagagttactctatgatccagcaattctactctagttttatatgaaaaataattgaaaatatatgtctggacatgtattgcacatgtttatagcagcgttattcataatagtcaaaaagttgtaataatcaacatgtttatcagctgaaaaataaacaaatttgctgtaactttatgatgtaatgttatctggccataaaaaagaaacaaagtccttataactgctatgacataagtcttgaaaatattatgctaagtcaaacaaaccagtcaccaaaaaacatatattgcatgattccatttatatgaaatgtccagaacagacaaatcctagagatagaaagtcgattagggggactttatttatttcaagggggaagaaggaaatggggagaggctatggtaatggtatgagttcctttggaataataaaagtattctaacattagatagtggtgatccttgtacttctctacgaatctactaaatctatagtagttctctccttttccatggttttgctttctggtttcagttaccagcagtcaaccatgctctaaaaatagatgaatatagtataataagatattttgagagagagagagagagagagaccacattgacacacttttattacagtatgttatgatttttctatttaattagtagttattgttgttaatctcttaatgtgcctaacttatatttaaacttcaccatagttatatatagaaaaatacataatttatatatagatggtccccaactggtttgacgtgatgtcttgtctttacaatgggataaaagcaatttacattaagtagaaactacacttcaagtacgcttacaacaattatgtttttttgctttcagtggagtattcaataaattacatgagatattcaataatttattataaaataggaattgtgtttttctccaccggtaagttaatgtaggttctgagcatgtttaagggaggctaggataagctatgatattcagtaagtatattaaatacttacaagtacatttccaacttacaatttttgtcaatatacaatgggtttatcagaaaaataaccctattgtaagttaagggatatgtgtaaccctgtatagagttcggtgctatctttgattttcagacatccactgggggtcttggaacatatctcccttggaatagtaaagggggactattgtactgaattgtacacctaaaaaggtgaattgtatggtgtgttaattatgtctcaataaaattattatttagaaagataactaggtaaggaaattcctaagttgtaagtcatcctatttatatgcaacatatggaatacatacattatgctcatctcattaatatagcatatttagtgactgctcttttctctttacaatctagaaaagccaatatgaatataatgttcatattaatacattatctttataatcacaaaggagaagcacattcagaaaatctgattcagctaaactttaaattttatagccagataaaatgcaacaaatatctgaaatatgaaaataaataaagcaaataatatatcaaaaatcttaggaatgatgaaatgactaagagtttgtcttaatttaggtaacaaaatctcctgaaacatttatacatttaaatcactaggagttcacaataagccatgtcagggttatctagaaagactgattatgtatcatgaatattaaagtattttgaattaagccttgtagatgttgcttattttgttttcaatttttatgacgtctatatcaaatgcgatacttttatttaaataaaattaataccatgttggacaataaattaatatttgagtcctctcattttgttgggatatataagaatattttgaaccaataggtggacaaacataagtgatgtatttcatacacacacacacacacacatacacacgtgtatttaactcatatgtataagacattgttttgggaaggagcaaagtagcttctgatagccaggatattcaggagctagccatatagtataaagcaggtttagagctaggtgtaagtgttcttctgatgaccatttcaacaatttcatagaacatcagtatcagacatggctaatctatgcaaatgagagatcacaaaaactaggctaacttataatcatatcaaatagagacaaaaccaggaacatcacccaaacaaaagactaacaaaacaatcccctgtcatggctaatataagtaattgctacctcttttgaaaacattggctttcacttctttcttgtcttttcctccatcctcctaggtaagacttaccataaacctaataataaaattctgctcccttcttgacaacttatccagagcaaagacccactctttgaaaccatcccccaaaatacaagtagcaagctcaagtcggtaagtcctttctaacatccttttatttagatatccctgtggatctacatgatgtgttttctcccttgttgcaatgagttataaacccaacttttgcaaccctaggtgtgttcccagtggtgtttgtctggtgactgccaacagcatcaacacacacatacagaaacgcatatacaagttatcttaagaaattataggaagagctaaatgccaaaaaaaggatatatcagagtctcaatgaaagaaatactagaaaatttatagtacatattataggttataattaattaatgtaagaaaaataaaacagataacaattaatattatgtttttagttcatcaaaagtttattatttctcctaatatacaggtggaaaggttattaatatcaatttgtgttcatacatcaacttactaattgctaatgtcacaaaaatgtctctgggtctttttatttttatatatctttaactaatcctaactactggcattgtgagttttcctatattaccaaaattatttatttatcttttttttgtcacatagtatctatgccattattgccagctattgtggaattcaatttaataaagcaaactgcctactgttgaacagtctgcaccttataacccactttaatcaccaaaaaattagaaacatttgtgaaaagttttacaggcatgagataatccagaattctcaaccttaatcacaaggcaaaagagaatgtatgatttattttggaggacattctgaaataattttaacattttcctttgtaaaataatcatctgagtgtgtttgtatgcaattcatctgcttctgaacaagaaaaggatttagttatgatatacttgattatgcatctacataagagatgcaatgtatgccaaacaaatctaggattaaaaattatttaccaagggcagggcatggtggctcatgcctataatctgagcactttgggaggctgaggcgggcaggtcacttgagatcaggagttcgagaccagcctggctaacatggtgaaactccatctctactacaaatacaaaaattatccaggcatggtgtcaggcacctgtaatcctagctactcggaggctgaggcaggagaattacttgaacccaggaggtggaggttgcagtgagccaagatcatgccactgcactccagcctggaaaacagagtgagagtctgcctcaaaaaaaaaatttacaaatatatacgtggttattaagcttttggaataatagcaatagctactaagaatttctttttcatgtgtatgcatcattttagatttagggagtacatgtgcaactgttacatggatatactgcatgatgctggagtttggggtacaaatgatcccatcacccaggtagtgagcatagtatccaacagtcagtttttcaacccatacttacctccttcccttcccactctagaattccccagtgtttattactgccctctttatgtccacgagtacccagtgtttagcttccacttataagtgagaacatatgatatttggttttatgtttctgtattaattcacctagaataatggcctcaagctacatccatgttgctgcaaagaacatgactttgttcttcttcatggctgcatagtagtccatggtgtatatgaaccacattttctttatgcaatcccatgttgatgggaacctaggttagttctatgtctttgctatggtgagtagcgctgagatgactacatgagtgcatgtatctttttggtagaatgatttatttacttttggatataagcccagtaatgggattggtgggtgaaatggtagttctatgttaagtttttgagaaatctccaaactgctctccacagtagctgaactaatttatatcccaacaacagtgtttaaacgttctcttttctccaatgccttatcagcatctgttggttttttaactttttaataataacaatgctgatgtgtgtgagatgttgtctcattgcggttttgatttggatttctctgattaatgatgttgagcatttttttcatatgtttatggggcacttgttaaatgcgtatctcaaaatgtcagaaagatatcaaactaatgatccaatatcatacttggaaaaccagaaacataagagcaaactaattccaaacctagcaaaagaaaagaactaaaatcagagcagaactgaacaaaattaagaccccaaaatccagggaaataatcaacttaaccagaagttggttttttgaaagcataaacaagattgataaaccactgtctacattaacaaagaaaaaacgacagaagatccaaataagtacagtcagagatgacaaaggtgacattacaactgatctcacagaagtagaatgattctgagagacccttatgaacacctccatacacataaactagaaaatctaaaggaaatgggtaaatacctggtaacacaccacctctcaagattgaatgagaaaaaaattgaaatcctgaaaacaccaagttttgaaattgaatcagtaattttaaaaaaacaacctaccaactaaataaagccccagaccagatggattcacgccaaattttactagatgtaaaaagaaaagctggtacccattctactgtaactcttccaaaaaaaaaaaaaaaacaaaaatgaagtcgaaggaactcctccctaattcactctatgaaccagtattatcgagataccaaaacctggaaaagatacaacacaaaaagaaaactacaggccaatacaccttatgaccctcaacaaaatactaggaagcctaatatggcagcacatcaaaaagttaattctccaactaagcttcattcctgggatgaaactgtttcaccaaacacaaatcaataaatgtgattcactgcataaacagaattaaaaacaaaaaacacatgatgatcccaatagaagtggaaaattctgctatgaaattcaacatcatgctaaaaatcctaaatagactaggtatctaagaaacatatctcaaaataataagagccatctatggtaaacccacagccaacatcatactaaatgggcaaagtctacaagcattcccctggaggactggaacaagcccagcctcacaacttctattcaacacagtaccggaagtccgagccagagctatcaggcaagagaaataaataaaaggtatccaaaaaggaacaaaataagtcaaactatctctccttactggtgatatgattctacacctagaagatgctgaagactccaccaaaaggctcaaagtttcaggacacaaaatcgatgtatacaaatcagtaacatttctatgcaccaataacattcaagctgagagccaaatccagaatccatttacaatatgaaatctcatttacaatagcacacacaccaaaaacaaaaaacaaacaaacaaacaaaaaagcaaggaatacatctaatcaaggatgtgaaagatctgtacaaggagaactacaaaacactgctaaaagcaatcagtaatgacacaaacaaatgaaaaaataccccgtgttcatggcttggaagaatccatatcattaaaatggacataatgcccaaagcatgcacagattcaacgtatcaacctacgaatgtcatttttcacagaattagagaaaaactatactaaaatgtacgtagagtgaagaaagagattgaataactaaagcaatcttagagaggaaataaaaaaagatggaggcatcatgttacctgacttcaaactatacgtaagtctacagtaaccaaaaacagcatggcagcattgcactggtaaaacaacaacaataacagacacacagatcagtggaacagaatagcaaaaccagaaataaagcaacatactgacagccatttaatatttgataaatcaacaaaaataagcaataagggaaggaccccctattcaataaatggtgctgggaaaattggctgtccatatgcagaggactgaaactggacccttaccttttactatacacagaaaagtaacccaggatggactaaatatataaatataagacctctgactataagaatcctaaaagaaaacctagaaaacaccattctggacatcagccttgataaataatttatgagtgagtccacaaaagcaactacaacaaaaccaaaaattgacaagtaagattaagctaaagagcttctgcatagcaaaggaaactatcaacagagtaaacagacaactgacagaatgggaaaaataaagtggagtattctcccaatgtgatagtctgaaatatagtctgaaaccaggggcacaatgcactgtggaaagccgtagggacctctgcccttgaaagcggggtattgtccaaggtttctccccatatgatagtctgaaatatggcctcctgggatgagaaagacctgaccgtcccccagcccaacacccttaaagggtctgtgctgaggaggattagtaaaagaggaaagcatcttgcagctgagatagaggaaggccactgtctcctgcctgtccctgggaactgaatgtctcggtataaaacccgattgtacatttgttcaattctgagatcagagaaaaaccgccctatggtgggaggcgagacatgtttgcagcaatgctgccttgttattctttactccactgacatgtttgggtggagagaaacataaatctggcttatgtgcatgtccagtcatagtaccttcccttgaacttaattatgacatagattctattgttcacatatttgttgctgaccttctccttattatcaccctgccctcctactacattcctttttgctgaaataatgaagataataatcaataaaagctgagggaactcagaggccggtgcaggtccttggtatgctgagtgccggtcccctgggcccactgttgtttctctattaaaaaaaaaaaaaaaaaaaaagaatgggaaaaatagtcacgatctatgcatccaataaaggtgtgatatgctgaatctataaggaacttattcaacaagcaaaaaacaactccattaaaaggtgggcataatacataaacacctactcagaatttctatttggagtttcttcagaattctcatctaagaactaattaatacaattgaattatggaatatgtggaaaatttatactataaaatatatcaaaaattttactaaaataatccaaaatcacaataatctctaagtaaaaaattggaagttttaatttagcggactcactcctttcttgtcagagtgtggtagttctcatactgcatggaaaggtccaaaacaatgttaagatggcaaaaacatgttttgaagaagtaaatgcatttgtatcattaccatattggaacattgcattttcaagttaaaatttgtttatactttgttgacatctgcccttcagtgttttcaaatttcaaatgattgcgacaccatcttgtcagtaaatggctcttcattgctggatggttattttaattaaatgtatctaaagtgaaaataatgtctggatgtatcccaaggacactgagcactccaagtaatttcatgaagaaagctaaaaatatgttactcaccgatagcttttgtaaaggtcagtacaggtggaattgttcttgcaaggattcattttacactcattggattcttgttcacaaaaatttccttcccaatcagataggcacacacactggtagctctaagagaatatgaaattatatatttttaggctatttcttactattaagcctataatacagatattactcctggccattttgatatctctgtcaatttataatttttttagttttatagaatgccaatactccccccaaatgacttttaccacatttttaaaagcgtgtgaacagtattctttagtatctaattaaataaagttttgtagtaagtcaatagattctacagaaggtattaaagatttatgcattatgctcacaatgtagaattatcatctttgttaaatgttttaaaagaaaaatagcatgttagtcatatgatggtagatgatggagtataactaaataactaattaaacaactcagcaactagctcacaagttaaaaatacaagtataaataaggaaacttttgacagatttattgttacagataaatatttaaaataaattaacagacttttggtcaattaaaatcgtaaaacttttcatggtgtttttctgaaacagagagttgccctatgacaatgtaattcagaatgctagaggtaaaattttgctttcctagtattgggcaaacaaacaaacaaaagaaacactttaaattactctgtgaaaatactttctatatgaaaaatatttttgaagaatagagctcttgtcaaaattagattttgggcttttgtctgtagagaatctagatatagcattataaaaacggtaaaatcaatgttaactgttatttaaatctgcacttttcaatacagtagccacatgtggctataaaacattgaaacatggctagtaccatttaagatgtgctataaatataaaatacatattgaatgttgaaaagttagtattaaaaaaggaatgccaagtatctcactaaaattttttattatttactttcggttgaaatggaaataattttgatataaagagttaaatgaaacgtacgatttcaattaatttcatttatttccatagctttttgtagtggctactagaaaagttaaaacacaaacagagatctcttttaatttctactgaacagaggtgagagttgagttagataatgccagcccagtttctccatttgtggatagagttaagaagtctatatacttataagcacaatgtgatgagtaggagccctgagattacagaacgcatcttagtttaatacatctcaacatcctgtacagatctagcaccctatgtttaattaatgttgattaaataaacagaaaaaacaaacatgatatgaccaataatttaaaggttgaagttagtagccaaaacaaaattcaaaatgatccttcatcactttggtacatttggacagcaaattttttttacaaacataacaatgaaacatgataaccagaagaaaaataaatgcatgctccatgtatgtgcatttagtttacaacagtttaaatgtataagaagttctactcagtactgtgctttggttgaacagggccaattggttttccatgctaggtattaataactagcttaaaagcacaagaatgagagccaccttttcaacattgtgctttattcttgacacatatactagtctccactcagaataatctttaagggtactccagttttgctggattttagcagatttttttttcacataccatgctccctacattgttaacttcctccatgagtgtggtaacatttacagttttcattggttgcgtttggcttattttttctttttttttttttttgtaaacattaaaagaggacttacataaaaattgaatataatgattatattttgttttatgaatgtgctatttaaaatgaaagcaattccacaatagtcaagacaacatcagctgtggtgaatgggagaaaatcatcccactcagtagcataaatggcatatgcataaaatcttcgggacatgcccattcgttatgttctgaaatttctcatattatggggtataaattatttatgtaaagacaaatgcataagcacactgctgatttttattttgatgcctcaataatattttgaaacaaatttagtgagtcaaaaattcagtcaaatttttcctattaaattcatatatttcttaaaagctaataactattggtattttcaataacttgataattagtagaaaattgtcaatttcagggtatcattatcattaaagtatcaggtactatagcagtgaattccagatatgatgaactatatacaaaaagaaaacataaaaggatgaagaaaatataatttaaaaaattaaaatttaaagatgtaaatgatgaagagaacaaaagtgcatagcaactaaaaataacccagagtttgagaatttttattcatcagtatcttacttgattcaaaagcattttcctcaatttagacattcttgctgcaaagcagtttctcattcaacattgaataattgattccagtaatttaaaataactgttccttaaatttgcactggtcaatacagtggccagaatagtattaaataatattaaatattgtatttaatattattaaatattaaatattaataactattaaatattttaatattaattataaaaatagaaattatattccactagaaaactgaaatataattaatattaatatttaatattttaatattaaatattaagtaattattaaatattaaataatattaaataatagtaaatactagtattaaatagtattaaatagtattaaagtaaaatactatttttaaaagcacattttcagccaattttgatggaaaaggaaagtattattaaaatgtgtttaccaaaaggagtaaaggtttacattatttattaaattagaatcttatcattttttaacttctcactacaaagtagacattactcttcctactaaacttggataaaacagtagtttgaaaatatgcatgtgacaggaaagacagatgataaaaacacaggtctacaatattgaactctgcagccagtgagaaaaaaataaagacaaagctgtcaagtttgatagttgtaaatgcataaactatatagtagttcactttttcagatcaacagccagatattttaaatttttcttatcagtaacagatgtactaaagtaagatggatagcataattgtgaacatgaattttcaagttagagagattaaacaatatctctgatgcttattaaatctctagacatctagtatattagttttctcttactgcctaaaagattactacaagtttcgtgtcttaaaacaacataaatgtattgtctcacagtttcaataagtcagtgtacaagagtcagtcacctaaatcctttgctttcggtctcaccatgctgaaatcaaggtattgactgggatgtgatctcacctaggaaatggagttctcttccaagttcaatgattgtagcagaattcatttcattctgcctctaggactcagatctcattttcttgctagctaccaggtaaagactactctcagcgtttagaaggtatttgcaggtccttgacacatggcctcctcctctcacagcatgccagtttgtttttttaaggacaacaggagaatctctgctgttacctcttgttttgttaaaggcccatttaattagggcagcccatgtaggacaaccacatgtttgattaaataaaagtcacttattgggggtgttaataacactgtaaaatctctttctacatataatataatcatggaagaagtatcatatttacaggtttcactcacacccaaggggagattttacagggcatatacaccaggagatgggaatctcgaggatcatcttaaaattttgcctttaatatctactaatctacttaatctttccaagtaacctactcaagttctccaagcctcaggtgccttcatatgtaaagtactaacaatttatacttcataaatatacttaagccttgaaggtagtaataactataatattcttagcctagcgacaaataattatcattaattagtagtagccattacctctaggcaaaacagtctagatctaacaacgtcaaagaataattgacagaagtaccacgattggctcaaacctattcatcaatacattacttatttttataaacatttaagccatgtaataagagataaccagactaggaaaaacaaagaaggaggaagagcaagagaatccagcaatatgtaatttatgaacacagacttacatgaagtggattaatataagaaaatataaatgaggaaaatgtattcaagatgaaatagaaaatcacactaaaccagtagacatttaaaaatataccaaaggagggagatttgctaacatagactcaaacaaaattactcccaagtctttatttattctcttatgccacataggtgaagagaatagaaaaacaggaaaaactactcaaattattttttgagactatcaaaacctagctaccaaattctagcaagcatataacaacaaatagaaatttagccaatgtttttaggatcaaaaagtcaatttttttcaaaaaaacataaatttagatagtcgaaaacagtaatgtatttaaaatacattatatagtttgagctggaaatatgccagaaatggaaatatgcctcaacacaagaaaatcttttagagaaagaaaaatggttttatcatttcagagcagaaaaatattttataaaattcaatacacattctaaaaatttcttttagcaaatgaaaacaaaatgggaatgtacttacattaacaacaactacctacaaaatgatttaaaaaaaccctgccaaacatcagtttatcaaaaacaaatgtagaaactgaataaaaaatatatacacatatacatatacatatatatatatatatatatatatatatatatatattgttgaattgttacaagaacaactgaagttgactagatcttctaaagctaaagagataagaagcaagcaaagttaagactacagagggctctgcttttcaaaccaggacatctgcccatttgcttccagataagtagttgcatctagataagcagaaagtagtagctggagtttgcagcagcttctttgaatgaaaagaaaacactagcattcagcttggtcaaggagattaggtccgtgaagagaagaacagagaagtgagcccacaatttgatcagccctattctatagaggcacttgttccctttcaaccttgtatttatagtatgaaattacacagaagtaaagcattagcagtctagtagtgcaaggaagataaaagttggagtttagggccagcaatatcttacagtcttgttaaacacttctagctttcaatgaacacaacagaggggcatatcttgaagaaaaaccagcaaaaaaacaaaaacaaaaacagctttaacggcatgaaaaccatacttgcctaaaatgtgatcatgcattcctattctgtctgccagaaaaataaaaataaaaaatcctctttggaagatgttaacattagatggagcttttcaaagtttgaaacaaatgtctgccattcaataaaaaagtttcttaaatgctgattaccaaatgtcaagagacaaactgacagtagaaatatactattgagatactgtgattattggatagagatttaaaaatacttatgatgaatacatataaaaatatagaagacaaatagggaattccactagaaaactgaaatctataaaagagacaaagaaaaactctgagtttgaaaattataacctgaaatttaatgacttaatatattattttaataatagacttattagacagaattaataaacttgctagtaaaagatatacagattgaaatatttatataaaggatataacagtcataaaagaaaacgaaatatgggaactaatgaaaatagccattatttgtttaattggaatatcaaaaacgaaggtagagaaattgggcaagaacaatatttgaaaaattgctgcctgagaattttcaaaagatggcaaaaagagagtgaccacagatttagaaagttcttgagacctatgctggatacataaaaataaaactttatctagattaaaacttctgaaaatgaaagacaaggagtaaatcatacaggcagccaatgaacaaagacatattatcttcaaagggacacaaagatcacaacttactccccagtatcagaagcaagaacccagtgagccaacatcataatggagtgaaagaaaataactgccaatttaaacttctatacccagtaaaaatacacttcaattatgaaagcagaacaaactcactttttacaaaaacaaaacctgagaacttactgcaatgtttaagattgtgggaatttgttgacagatgacctggatttaaattcaggctctaagaattatgacttatataattttaagcatgttacttaatttcaaggcacatcagaaataatgctacctgcccaacgagggtataagaagtacagcactgagtataggacgtagtgtaatatctaacatagtaagacaaccataaattttaactaaaatgttctcatatactgtgacttgtccaggtaagctaaactacttctcagtctctgtgatgtttgtttcctttactttcttccacttggaatgactttgtctacttccaccaatccctgaccatactttccaagttttatccacctgcaaatgtcaaaacaagtgccacatagtacctgaagctttgataatttccttcagcataccttctcttacttactgttttagattttatgatacatttaaagcatgttagttacttatgtacatataagctgtattctgcttagtgcttattgtatttaaaaatatcttaattatattattgcgtatttctctagtttctaaagtataaattccaagagggcagaaactttctttactttgttcaacaattatcatcaataataacatctggaatagtgtctaatgtttgactgaataggtgctagagattggaacatctataatgatattcattggtactaatatagtcatggaggatattttatttatcatttctagatatttaataatcttattttcctaacaagaaaaagacttttttaaaagaattcatttaaataattatttcattacaatcaaccaaaagcagttctataaatgaaggattaaaatccccattgaaagaaaacttggattgcttccattttgaaaagtttttatacattagaattattgtattttattcagtcttagccacaattttttactaacatgtgtgctttgtgaaactttctattagattactgaaaatgtagatatatactgaaaaaaatagaaatttcaaattatagtctctttctgatcattatttatgtaactcttgaaagaaggacaaatatttttctttgctttaataaaaaaacttttgaagtaaaatttgtaatgaatttaatccttgtaaaaataaagggctctccctattgacttattatctcttttatttaaatgttattttaagttttcactttaattcataaatacttatagagttggctatagacacaaaggtttccaaatactgaatgctgatactcaggattatacataaaaacactaatctttatttataaaaacaaacagaactatcttaatatgatttctttcagcaagagaaaatgatttatcttggtgctttaaatctaaagtaaaataatatgtattattctgacagaaagtaaatggaatatttagaaacaatttctataaaaagttacaaacactgaatttgattgaacatattttgaaataaggcaaagaaaatacactttacaatgagtgatactttcaaggcaaaacttgtagaaaaacacaatttcttttacttgggaaaatgtaatacaaatacatgaagaatatgaaaagtcacatggtagaggaagataatatagagtataaatcaagctatactggattttgaaaacattttctaaagaaaacataaacctctaagaaacttagtcattgttcccatgtgattatacttttcattagtaacaaaaaaaaaagcaaatggtcattttagtgcctaatattccaaatgagaaaacaaacattaagtataaatttccactggttttatttcctatatctagtaaatctactatcaaaataacttcagctgtttgtctactatgctattttcaatttatagtttttattagtaatctttacttataatttagttctcttacggcatgccctaccttcataaaccatttgtgatcctttttaagggttcctttacctttaatgtcggtttaaaaaaaaaaagaatttaaaactagaataaagaagtttagactaactgtaataaaccatgggaaaaaataactcatctgtcattgatgtgtactgctcaaacatatttattatgttttgaatattatcttccttattgactcaatttgacaattagagatatagtctaatacccaaagctttttccctagtacacaaataataagaatatagaaaatataatcttgtatgagatgatcacataaagatgacagtatataaatgtaattctgcaacatatagttttggggagcattacatgttttggtctgagagccaaatgacaataataatgcaagtacaccatggactaaaaatcacttgtaagttttgaaccacaagtacaaaactcatttccagtattatgacctcaaagaaaattagcaactgaggcagagcaagatggtggaatagaaagcttcgtcaatttttcccccacccctggcaagggcaccaaattaacaactatatacactgaaaacaccttcataagaaccaaaaatcagtacatacaaaaatcagtagtatttctatatgccaaaagtgaacaaactgaaaaacaaatcaaaaacataggctaggcatggtggctcacacctgtaatcccagaactttggaaggctgaggcaggtagatcacctgagatcaggagttcaagactagcctggccaatatggtgaaaccatttctctaccaaaaatacaatacaaaacaaaaaattagccgggcatggtggcaggcacctgtagtcccagctactcaggatgctgaggcaggagaaacacttgaacctgggaggcggaggcagcagtgagcagtaattgtgtcactgcactccagtccagcctaggtgacagagtgagactctgtctcaaaaaacaaacaaccaacaaaaaaaaaatcttaattccatttacaatagccaaaaatgaaattaaatacctaggaattaaccagagaaaggaaagatcacaataatgaaaatatacgacactgatgaaggaaattgaagaggacatcaaaaaaatgaaaaaaaaattccatattcatggattagaagaatcgatattgttaaaacatccatactattgggagaggacatagttagaggctggctacacacacagagagggagagtcttgggagagaggcagtgcgcatggaaacacactggcaccacccttgtggtgtagttagcaggaaaaaatatggttaagaacttcctcttataccaggatgtttgctcagaagggatttattgtgcaagcacaataaatcaactaaatgtcctgaatatgacccagagctaattgtaatatcatcggcattgcagttttggctccctatcccatgggttttgcttaggcattcttgggtaataactacgatggagtcactatggtctactccagatatgcatagatgcaacgtccccgggggagcgggggaactttactcctcctattaaggcagaacctacgaaaggctttcttatttttccccacagaaaaaatatccccagcactcagaaccatttctggcaactcgctttgggtcccctctcactgctaataatttttctattgctttacaaattctgctctgccttactcactctctggtgtccacatgccttattcttctttgtcctctgacaagaactcagacctcactaaattaaggaatagagaaactgcaatactatgcaaagcagtctacacattcagtgtaatctctatcaaaatatcaatgacatccttcacagaaatagaaaaaaaaaattccaaaatgtatatgaaaccacaaaagacccaggatagccaaagctatcctaagcaaaaagaatgaaatggaaataattacattacttgacttcaaattatactacagtgctatagtaaccaaacagcatgttgctggcataaaaacagatacagaccaatggaacagattagagaacccaaaaacaaatccacacacctacagtgaactcatttttggtaaaggtgtcaagaacatgcactggagaaaagacagtttgttcaataaatggtgctgggaaagctggatatccatagacaaaagaatgaaactggatgcctatctctcatcatgtacaaaagtcaaatcaaaatggattagataattaaatctaagacctcagactatgtaactaccacagaaaactggggaaaatctccaggacattggtcaaatatttcttgagcaataaccacaagcacaggcaaccaaagcaaaaatggacaaatgacatcacatcaagttaaaaagctcctgcacagcaagggaaacaatcaacaaagtaaagagacaatccacagaatgagaggaaaatttttgtaaattaccaatctgacaagggactaataaccagaatatataaggatctcaaacaattttataggaaaaaaactctaataatctgatcaataaatgggcaaaaaatttcaacagacatttatcaaaagaagacacacaaatggcaaacaggcatatgaaaaggtgcttaacatcactgattatcagagaaatgcacatcaaacaatgagaaatcatctgaccccagttaatatatccaaaagacgcaacaacaaatgccggtgaagatgtggagaaaagggaatccacttatactgttgatgtgaatgtaaatcagtacagtcactatggaaaacaatttgaggttcctcaaaaaactaaaaatagagctatcaaatgatccagcaatcccactgctgggtatacaccccccaaatgaaaatcagtatatcaaagagatatcttcacttccatgtttgttgcagcattgttcacaatagccaagacttgcaagcaacctaagtgtccatcaaaagataaatggattaaaaaaatgcagtacacatgcacaatggcgtactattgagccattgagaagaatgagatcctgtcatttgcaacaacatggatggaactggagattattatgaagtgaaataagccaggcacagaaagacaaatcaaatattgcatgttctcacttagttgtgagacctataaatcaaagcaattgaattcatggacacagagagtagaaggatggttaccagaggctgggaagggtagtggatggtttgggagatgtgggaatggttaatggataaaaaaaaaaaattagggagaacgaataagatctactatttgatggcacaacagggtgcctatagtcaataacaacttaattgtacattttgaaataactaaaatagtgtaatttgattgtaatttgttgtgtaatttgtaacacaacagatgaatgcttgaagggatgaagacctcattctccatgatttgattatttcacattgcatgcctgtatcaaaacatctcatgcataccataaatatatacacctattatgtacccgcaaatataaaaataaaaataaatgcaacctccttcatcaaaaaaaattagtgcctgtaaaagtggaaaaatcgtctaggctttttcacagcaaaacagagacaaataccaaacaaataatatggtatttgcttattgtttttaaatattttcaatacctacttaaatagttcatttaatcacctggtaaaataaaataaaatgaccaatatgagataatataaagaaacgttcaactgtattttagcctatttgacagttttatgttctgtaaaacttctaatattttacatttattaggatttttttctgtaaaatggttttaagtttgaactgaaagcatttttatgtaattctgtatatatatcacacataaaatatatttgtataattatacatacacaatgtattacatataattataaatatacctagtatatataataacatacgtatataccatatgttgtgtgtatatgtatataacatcaaattttggctgggtgcggtggctcaggcctctaatcctagttgttcgggaggctgagacatgagagtcgcctgagtccgggaggcagcggttgcagtgagcgaaaatcgcgccactgcactccagcctgggtgacagagtgagactccatctcaaaaactaaacaaaacaaaacaaacaaatttaatgtcatctgaatctaaacctcactttcacagagattaagaaacaatcttcaggccgggcgcggtggctcacgcctgtaatcccagcactttgggaggccgaggcgggtggatcacgaggtcaggagatcgagaccacggtgaaaccccgtctctactaaaaatacaaaaaattagccgggcgcagtggcgggcgcctgtagtcccagctactcgggaggctgaggcaggaggatggtgtgaacccggaaggcggagcttgcagtgagcggagatcgcgccacagcactccagcctgggcgacaaaacgagactccgtctcaaaaaaaaaaaaaaaaaaaaaaaaaaaaagaaacaatcttcagcaaatatacatactgtaatcaaactgtggtgtttctttacattttatatttcataaacataataatttcttggcaattggtaagaggaattctggaaacattacagttagacacacaatcattggagtgtaaataatataaactggcttcatatcccaggaccttaacaattattgaatgacttgtatatctgtaggttatagttccttgataagaggactattttgtcttatggttagccattatgattttgttgctggctgatagactacctgctttgcattagaaaccagtaggggtaagatgggggatataaatactcagtcgtagttgtggtaaccatgtaagcggcaggtgagaagggagtagaacaatgtaagaatacttagaaaaaatgtgagctacaatttcgaatatccctgtcatcatcagcatgttggaattccataattcctcaataataattccaagaagcaaatttgctgtaaaactcattaatttatgaaaacaagccctccaatctgtgttttgcattgtagaatgtgttattattgacataatcattactcctctcctcagagtaatcagggatatcagaagcataagtgtttttttcttttccttcattattctttattttttgaattcaggaatgaaggttctgttgtcattctatccacagataccataaatattttctacacacattaaaccactcatgatattgacttaatgtgaatggagacatgggtaaaatgccctaggcagatgtcagggtatttgattctggtcccagatgctatgacatgtaggctattgaacatcttatccaattggtcataactggtcttaattttaaatcaacaaatttgaactcagtgattttttttactctttcaattctaaaatgattatatttttattgccttatttatagtttctaaaagcaccagatattaacaagaactgtctctctattgtgccaagtattctgaccagatgtctaaggtgttcctagtgattggttaatccctgagtaacaaaactatgttgtaaagtttcagctgcaaacacagttaagtagttcacgactcaggattttttttttttttttttttttttaagaagaaccactgttaaagtttgtctttgttgccaatcacttaccacagtgcatgggcaaatgtgtgtttaaaaacttgcagagagaaatttgtattactgagtcacaatgattgatgttttacttaccaagcacataagtgatattagtcttaatgcctttcaattgaataaaatcaatggtaattttcaggtatagaaaaaaagtggagtctctaaggctaagtttgacttgtgatttgaagtttacaaatagttttccagatattttcttaatcctgttaacaaatatttataatgagaggaaattactaataccttctcattataaatattaatatgaacaataaaagtaatctttgattatgtagaatatgtaaatagttactttatagtcatatgtcatataatcattttcttgtaaaataagggataattttaagcaactgtcttcaaatgttaagacaaaaatgattttgaaaggatttttccttttacctttttaaattgctgtcaataattttttaacaatgtagaacctaggtcactgaatacagtgttttgtataactttgttttttccaatatatattccaaattatttataggttttccttttcattttctacttttagaagagccaattgtgattcaacttatatctacaattctgagtctgttcccaaaatctttgatgtcacaaaataaatccgtgccatcttacatttggcatttctatatttttccttctttttaacttttatattaagttcaggggtatatgtgcaggtttgttccatagataaacttgtattatggtggtttcttgtacagaatattccatcatcaggtattaagcctagtacccattagttatttttcctgatcctctccctactccctactgccacccaccaccctctgatggtccccaatgtgtgttgttcccctctatgtgtccatgtggtctcatcatttagctcccattgacacatgagaacatacagtatttggttttctgttcctgggttagtttgctaaagataatggcctccagctccatccatatccctgcaaagacatgatttatttcttcattatgactgcataaaccatagtgtatgtgtaccacattttctttatccagtctatcactgatggtcatttaggttgattccttgtctttgctattgtgaatagtaccagagtgaatatatgtgtgcatgtgcctttataatagaacaattgatatttatttgggtatatacctaggaatgggattgcagggttgaatagtggttctgtcattacatcattgaggaatcatcacactgtcttccacagtggttgaactaattgactttgattatggaatgtagccctttaaagacgtgtttcccaaaggaacattttggtcagtggtgttgtatgtatctgttgttgtaaactattaattattcaaataaattttaatataagtaaatgaaatcctattatgatcatctaactgtagtgaacaggaatgaagtgatcagttatcctttccaatatatcatatatatatatatatacacacacaatttatatacacataaattgtatatttgtatatacatgcatatctgtgtgtgtataattcctcttcctctttaaaatactcaacagctacactgttcacctctcagtcatttataagctaggaataatgtttttcaaaaaatgcatgcttcatcagtacaatggaataagtccagagggaatttataaggcattttcatgtattctattcattttattacatcattaatcctctcccaactcacaatcctaccaatacacctttataatgctcagtgcacttgagttgcaattcagcttctgttttgagcccttatgctattaggcaatttacttagcctatctttttatttataaaactagaaaaataataggaaatttgggggagataatttctgaagcggtttttctatactcatatactaaaaattcataatttatctatcatcataattattttattgatccattagtattttaaaattctcaatccagagttttcattcttcaactctagtgaagtcaccaaaaacataatcataacttcctcacgtttcccctaagaaattttctatctccaaaacctcaaattatgatattctgttctttgtcactacttcttcagctttatcactcctaaccctgcacttctattctagttgctattcttctcagtatttctcggttagcacacttgctttctagccattagttctttctcttcacttttcagcataaacaccatcataagggggtttccaaaaactacaccactagtagtaaatgagatggtctgataaacagaggtttattttattttaaactttatttatctagttgtgttaaataaaaataaactgtttatctaatttatctatgtatctctttatctctctctttatctaattgtattagatagataaattgtgttatttctttactctaaattgtgttacaaaaacagaacaagtaggtggggcatggtggctcatgcctgaaatcatagccctttgggaggccaaggcgggaggatcacttgatccagcagtccgagaccagtctgggcaacataggaagacaccctatctttacaaaaaaaaaagaaaagaaaaaaaaagcttgtcatggtgctgtatgcctgtagtcccagatactcatgaggctgaggggctgaggcttgagggacgcttgagcccaggagtttgaggctgcaatgagctgtgatcacaccattgtactccagcctgggcaacagaataagaccaggtctcctccccaacaaccctcaaaaaaagagagagagaaatatagaacaagtgcaccaaattctgaatagattaccgaagagtaagtatatcttaattaaaaaatgatttaggtggtataaacatttgtatcaagaacacaaatttctataattttgattagctcgatgaggcttaaaaatgtgtgcccttagtcctattatcatatctccttgcttctgtattactgtactcaggactatttgaatgatattttctatgtagtttaaaatgttttgaacttttatggtaaaagatatgcatatgaatgtgtgcgtgcatgtattattctgagtgtcactctacagacaatggtttatctttctttagcagaaaatctctctctaggtgtagtaagctagtgttctgattagaaagcccacattctaaagatagttactgcaaatacttcagttatctttatctctgaccaacactcaatacttttgcaaatagcaaaatattaatttacaaattggatttcattagcgaaattattattaaacatatatagacttagtaaatattttacagccattcttagttacttcttgaccaggatgtagtgagccctatagtcattagccataggaatggcaccctaggtttgataatttaattatcctttacctctcccttcgttcaggaatttcccattcttttgactctgaaagatgttaagataatccaacgacttgaatattgtcaacagtgacctactgtgaaacttttatgcaagcaatttctgagaccaccaaaagatagagaacagagacctcattgatgcaataaatgtgtgcacgatagcataatttggcctatggcttgtttttgataaccaagtggtaaattagtgaggaaggaagcaactcatacaattttagctattcgtagtgatagagacacaccaagtagaaactaataatattatctatgttcaaacagattttagtcaatttccaaatccttaagtacatttctattcattttgtcagatgagtgaaataggagtcttttgtatatcaaaagttcactgaacaattaataacatacagcacatatataaaatgctgaccaacagcaaaatatttctttagaaaataaactcttttaagttgtaatacataatatagaattacaatatattatgttgtacttttttattaggtaaaacacacatgaatacactacctacttttaagcaataggggttaatatttcctgttagagattagaaagcaatggttatcaactggattttataaaaccttacatctataacttctcaacaaattttaccttttatgattatcactattacatatttttaataaacacacacttctcacactatttgaaaataagatctatatcatttgggtttaagataaaagtagctcaaattttagtgagattttaatatagggctctcgatatgtattcatgtaaattatgaaggaatttttatttcctctttaatttggaaataatcactttttaccatctgtctgacttccttcccttcaaaagttttcatacaatattctttatgattaaatggatattcagcattccttattccttaaaggaaaatctttcaacttttataaatgattttatttaattattagactttttagctttatgttattactataatgtgtcaatttaaaatgtcatatgttaaattacatttttctttcctgtccactgagataattcgtatattctaattttagtcaatatttgttgataaaatatcttatgtttgttaaggtgaatatttgggaaatttcctgtcacagtggcggcaccagcaagcaattcatcaaagtatgagctatattctttgctctttagcggatgcaaaataacataaaatatgtctttttgcctaaaaagcaaaagtatggaaagtttctattaataacattaataaaattgagttcattgaaatgaattctatataggctgggtgcagttgctcacacctgtaatcccaggacattgggaggccaaggcaggcagatcacttgaggtcaggagttcaagaccagcccggtcaacatggtgaaatccccatctctactaaaaatacaaaagttagccaggtgtggtggcatacacctgtaatcccagccactcaggaggctaaggcacaagaatcacttgaacctgggaagtggaggttgcagtgtactgagatcacaccattgcactcctgctggatgacagagtgagactccatctcaaaaaaataaaaagaaattaattttatataaaacaatttaccctcatgcccaagggtaataaataaatgctattaaattatatcatcataatattaaaactgcaaaattgaagcacagaaaattcatgtagtcttttttggataccataagtatttgctaaatatgtattaaatgatctgcatcctaggagtttgaaatactttagcgaacagaattgacaaaatattcctgcttgaatgcttgtctgaaaattactataatgtccatataggaagatcatagtattgaccataaatgatcataaaaagataataaaatagctattgtttataggcctttttgtccaatatattatatatgttattacaatgtaaatgtatatatattttattttttacatataggaaagtaaatgcattgatatatttgtaaatgtgctgattaacttgtcactaattgaagaatcatataaatgaagatcattcagacttttcattcttcattataaatgaggaaagcaaaatgacaaaataaaagaaaaacccaaaaagggaaattttctaactcatgagtacccccatgagttttatactttttatatagcatcatccctaacttttttcatttattttatagaggttatcagatttattacaaagtatactgaccattcaattggttttatatgctccttgattgcttgcttttttatagtttatgagcagaaatattttagatacatatattaagatacagctacctacaaactattactgaaaacagaatatattttatatattagagatacatagattgtgaatcagtttatggcttgaaatttgttactgaaagttctgtcttttttaaaaggcagcgactttaagaagtgtttggttgcctaatagctgctgaaaattgtgagtgtgtgtgtgtgtgtgtgtgtgtgcgcctgtgtgtgtatttcgaagtctattcaaaatgcttgtccattttactgggttgcgaaatgggtataaagggtacagggaatttaatttaatctggttaactgaaagttactccatgcctttgagttggagaaaagacaagttgatttcttatgagtgaattatttgttattaaatgtatgtttttctgagttgttgctttattatttatatagataagtatcaaaatatgagaaaaaagattcatttgtcctatatgctaatggatagattatttttagctatgagaaaagagagcctaaattggtttgttagtatgttttgtcaaaatctagaaagaaattggtgttggggggggtattgtttaacttgttaaatgtttaagcttgttaatgatttggcagtcctgatggtttaatttaaggattgaaatatgtcatattctattaaaattaccatggcttagaattaataactgttgacaagagatgtagagtataaagccaaatatctgcttctctttatgtgaggacgaaaacaggttaggtggtcactctggggataaaagatatggccaccttcaaggggctttaggggaaaatctgttccatttccttttctagcttctagaactgctttcttatcatccttggtttatgcccaccttttccttcatctgtaaagacaacagtgtaacatggttgcttcaatcctcacatagcctttttcttctatcttcaaatctctttctgcttccctctgataaggatactcctgattacatttaggacacacacagataatccaggataatgtcctcaatatccttaatttaattgcatctgcaaaatccctattaccatataaagtaactttcacaagttccacaggttccaggaattggaacctcatctctttagtggccatcaagtctaccctttgatcatctggctactctctggcattctatatacaaaggtagccctccagttagcacatcaaaaagccatggttttcaaattaaattccattgcattcttaaattatattctactaattacatgaaattattttttctttgaagtttctttctaatcaactaccactaccttattactgggatattatctttagcttcaattatggcatccattttccatgtaatctgcctgtctctaaccatactcagtcctacttcatagcagccagaattacttttctaaaaattaaacacagctatgttactcagctccttagaaagactctgcttatttttaccattcatgggacaaaatctaaacttacactttggaataagctgttcactgtagtctgagatcaaaactccattttttttttttttaagacagagtctcactctgtcccccaagctggagtgcagtggcatgatcttggctcacttcaacctctgcctcctgggttcaagtgattctcctgtctcagcctcccaagtaactggaattagagcaaccacacctggctaatttttttatttttagtagagatggggtttcgccatgttggtcaggctggtctcgaagtcccgacctcaggtgatccacctgcctcggcctcccaaagtgctgggattacaggcgtgagccacagtgcccggcctccattgtctttcttatcacccacatcattccattcagtacaccatatgctcccactacactgaggattaacactactttacaaatctgtactataaaattaactccagtattttgcttggaaatctcccatttatcattcaggaaggcaggtgctaaatttcataacgatttttctcccttctgcaatgtataaaaatggctgctccatcttttgggttttcacaattcagtcttatttcttgtataatatttgttgtatggtgttaattttttaaaataaccactctatcccctcaacatgaatttgggcatgtgaaaagtactgtgcccagttcatctttgtagtcccaaagcctagaactcagcagaaagaagacattggacaaatgtgattagttaaatgaatgaggccttcagaggcaagtgaaatgaactagtgcccacaatacaacataaaagacaaatttgtaccctctcttcaagattacagccatatataacactagagtcctctcaagaaataatctttgattaaacaggaaattaacttcgatttttaaaataaatatgggtatttattattacttacagaaacagtaaaaaaatgtatataaaacacatctgttaacacttgacccaagatttttttttatgggaagtttaaaattactcagtgatgcagttgttctataaattttccactgccttgaaaactatggcaattttatattttcaaaacttgtttaaaaaataattttgctgatcaaataaatgtgttattctttcaaaatatatttatatgagtttcttcatttacaaattaaattttaaaatgtttgcaatttttctgatctaaaacctttgtatattcactcaaaaatacttttctccaatcaatctctttctccttttgaattgttacctgagagggtctgattgctttatatagatgctcgaagcagtattatttttttcagaaaataaaacaatcacattacctaggaccctcaatttggcttccaaaattctgcttgtcaaaagctggattgcctactccatgtttattttctttactagtcaatagccccattggctgtttttgtggttgccatggtgtgcccccagatctgtcttcatagctgaggctctcttagccccagcttcccagactgttggcagttgaaaactcatagctgagtctttgcctaggacctgtccttacctgaaaggagatgctttgctcttcttccaaccccagaccacatccaatcattgctttatatgaaggtacaaagaccaagctcttttccctcaattcaagatatctctaatgaggtaccccagctcaagcactttctgtgggattgcccaagatctctgttataattgctgttcaaattgtctatttctctttccttcactctctcacagacattgttttctgagtatttcacaatcaactccttgcgtgaaaaaaaaaaaaatctcatttcctaaaacttttcctggggaatctcccttaaaagagttggagaccggcatggcctaggacatggactgtaaaatgatgctttgaagctaaattgtcagctgaaagaaaaaagtctctgtcagtggttgcaggtggagtgtgaatggcccatagcatgctgtagtagggcaactgttaaaacttgctactagctggggactggatcaggataccagagaatgtctttgcaaatgcagtatcacacacatttgtgaggaacagtgggagtggaaatcacaataatgtaatcagatggctcttgctgggtatcattaaggcattgaaaaaggcaaagattaagggtgaataatcaccattttaaagaatgaaacttagggggtcactttggaagcatttagactccattcttggcagccacagatctgtaaaaaatgagggccaggtccaggacttacttctaaggacagtagagcccaaattccctggaacccactaggactgtagaagaagccacttcttttgcttgaagatggtgcagacatctctgcattccaagataataacatgaaactgctctccctaggatttaatcccacatagctagtgatgttaagattatatgataagccttccaagcaaagtcttccttcacacagaggttactagcctatctccacacatacaaaggcagtaaaaggtctaaacaattgtaccaaatgtgaagtctcaaaggcctagtagaatttcaccttggtactcttcagtctgtgaccccagatgttacctaaactttccaatctcatactatgtaaaattgctttagattgtcataccaatgattataaaatctgtggctttaatacagtagctatttctataataagaatgtaatacagttgttccatgaacaacacaggtttgaaatggacacatacatttataagcagatttttttcaataagtattgttggaaaatttggggtagatttgtaacaatgtaaaaacctcaaatatgaattgccaagcctagaaatacaaaaaaaaaaagttgtgaaaaagttagaaatgtaatgaatgcataaagtgtatgtagatactagtttatcgtattattcactaccataaaatatacacaaatccactgtgaaaagttaaaatttatcaaagactaagcaaacaaacacagatcatacatagtgctcatacatcccgagtagctgggattacaggcatgggctcctatgcccggctaatttttatatttttagtagagatggggtttcgtcatgttggccaggctggtctggaatccttgacctcaggtactctgctcaccttggcctcccaaagtgctagaattacaggcgtgaaccactgtgcctggccactgcaataattttataaccacctcctgtagctattgcagtgatcccaagtgttatgagtagccacttaaaacatcatgtgatgctaatcatctccaagtgagcagttatctctccagcaaattgtgcatcacagtaaaaagtgatttttcaaagttcttatagatttttcttcctgtttagtacaatacgtaaaccttgaataacaccactgaacccatatgaagtgccactagtgatgctgcaagtgctcccaaagagcagagaaaagtcatgacattacaagaaaaagttaaattgcttgatatgtaccatagaatgaggtctgcagttgctgccattttgagataaatgaattcagactaagaaccattgtgataaagaaaagaaaatttgtgacaccatcactgcagctacatcagcagatgtgaaaactgcacttctttttgtgaaatatatttatttttaatctcatatttaaaatgcagcttttatggagattcaggattgctctaaggaaggcataactatagactctgatataatgcaagaaaaagcaaaatcattatatgataacttagagcaaaatgaaggtgaaggatttcaagctggaaaatttaatgccaacaaaggatggcttgataattttaggaagagtttggcttaatacatttcaagataacaggagaagcagcttctgctgcccaagaggcagcagcagagttcccagatgccaataagaaaatcactgaggaaaaatgatatttgcctgaacaaatgcagatgaaagtgtcctattctagaaaaaaaaaaagccacaaaggacattcattagcatggatgaaaagtgagcatcgggacttaaggcggtagagataggctaactctactgttttatacaaacacacttgggtttattatgatcagggctgctcttatctataaagctgctacacactaagtttgaagggaaaaaaaataaacagcttccagttttttggttgtaaaacatgaaggcctggacaatgagaaacctttttctgacttggttccattgatgctttgtttctgaaatcaggaagtacttagcaagtaagggactacttttaaaaattcttttgatagtggacatgcccctagccactgacaaccccttgagttcaacagtgaaggtgtcaaagtgctctatttgttcttaagcacaatgtgtctaattcagcttctacataggggatcataagaatatttaaggttaattacacacagtactctctagaaaggattgtcagtgctggaagagaatcccgatagagagaacatcatgaaattgtggaagaattataacattggagatgcctttgttgttacagaaaagtaatgaaagccatcaagcataattaagtaagttcttgctgaagaaaactgtatccaaatgttatacaaaacttcccagatttatgatgatgccaatccaggaaatcatgaaagagattgtggatatggcaaaaaaaaagaataaagaaaaaacatggtcagggggtaaagcgtttctagcaatgtatcttggagaaattcaagagctaacacacaccacaccaaacaaattagcagaagaccacctgatgatgatttcttatgaaccagtgccagaagatgagaaagaagacgtggaagaagacatagaaaaagcattgccagaaaacattttgacattaggcaatctggcagaagagttctgattgctcaacgttggttttgatttcttttaggacatagactcttctataatacagctactgaaactaaagcaaatggcaggagaaggattggtactgtacagaaacattcctatagaaatgaaaaagaaaacagttatgacaaaagttactatgtattttcatgaagttacagaatgtgtctctctcctgcctctccttccacctcttccacctctgcgactcctgagacagcaaagccaatccctcctgttcctcctcttcctcactctagccaatccctcctcttcctcactctactcaatgtgaagacaataaggaccttaaagatgactcaattctccttaatgaatagtagatatattttctcttccttatgattttcttataacattattttctctagcttactttattgtaagaatagagtaatgcatataatatagaaaacgtgttagtagactacattactggtaagtcttccagtcaacagttggctattagtaattgtttgaggagtcaaaagttttacatagattttgactatttcaggggttggtgcccccaacacccacattgttcaaatgcaatttaacatgttacctaccaataaatattaatactaggcattataggtcttatctctaggtatgttctttagagtaaaaagcctactttcccaattcacctctaatgtatatgaatccaaattaaattaataagtgattgagaagaatcacaggtagaaaaatctgtaggcattttaatttttcaatatctccactatatcaggtatcattttaaaatataatttataataaatatggatctgacttcactattattttgtactatatgatttatagccctatataccgaaaggactagaaatactgttatttttataggagcataattaagtaaaattgcccaatattctttgacaaaataatacacctaggagaatctcagcctttcagaaaacaaatctataggaaagacatcttgttgattcacttaacagatacttactgactacccttctatgtactaggcactagccactgggcaaataatcaataagctatatcacatcattactcttacgtcataagtaagacatagatgtcttccttatgtatgtgtatataaaatcatcatagtctgtgctgtgaagaaaagggagtgttaaaacatacatctaacaataacacataatttagcttggcgggttatgtgatttttttatcacactttgtggtgaaaatagtttacttttctctctctctaagagtcccaaaggaagagattgtgtattgtttaccattctatattcattttaaagcacagcattgggaaactttattatttttgaatgagtgcataaactaatctagaaaaacaaactgagagcacataaagtcagtgattcatggagcatttattaactgaagatagtgctaagtctttcctaagtcttaaagactcaaagtgtaaactgcagtataattgtggaaaccaaataatggaaaattattctttggaaatattacctgcatttttcgtaaagcaggcattatttctcatttttaaaatgggctttattataatttccaagtcaaaagggtgaaattcctttctgttttagataaacatagataagtcaaattaaaatatgagacaaaatatacagaaagataattcattttttccctcaaaagcaaaggaagttttaaataacttaaataaatttagaaaacattcattgagaaagagaatatacacagcagcatgaaaaagcatttcacattggattccatcattacatttatgagcttctaagaattcacagattataagcacattatcaaagtaatttcttaaaatcatttgtttatatatttataaattgccttaaggaacaaccagagacatctattcaaaaatcgtatgtacagcataaagcactaagcaaaagaaatagattctggccaagttaaccaaaataaagaaaagtatgaaaggggatataatgtatttgaagactattgggttaacttacaataaaataagggaaaataaaagccttctcatgtaaaatccaaggtacttcttgtgattcaaacggtcatttttggcagcttgatctgaatcacctgaggtgcttgttaaaaatgatggattcttgagttccagctcataattactgaatcagactatctagtaatggcctccaggaatctgcatttttaaccccatcaggaaggataattaagcattttaatatttgttcttagagtgactctgctccaaagtttccaaatacaatgtttttctacaaatgtcaaaaatttgggggagattaaactacattttccactccaagttgcagaaccgtctctatcttcatgtccttataggatacatattatattacactgtcaatggcattatttgtgtggatacttctctcttaagttttccataatttatgagcttatttagactagcatcttgatagtctgtgtataccgcacagcacaaagaacaaggacttttcacgtttatgtgcttaaatgttacttgaattgaatgacattgataacatacaagagtaatgacagttttatgggtaagaatattacattgaatggacttcttggtgtgtgcataaatttaaaattgtaaaacttattctgagtcttattagttcattttatacaagagtaaaaaatgacagcaggctcatggttaaatttaatggaaaccagaggtccccagagaatcaaagtcataatcaatcatttcttttctcatatatttagtaaaatataccaagtttcaaaatctttttatttctctgaaaattgcatttgagattgattaggtcaggagctgcacacatttttaaaatcatttagctgctcatcctgatatctctctgagaatttctgatattgattagaaactgcaccacttattgaataagatataaaaacgataattttgtttttgacaacacccgcctgtattaatttatgtgcaaaaagacagctttccttgttaaaaaaaatacattactataaatataaataatgtaaaattcaagactcagagcaaaaactccttctctctgtgctgtaacttaaaaataattccccaggaggaaagggctctggttatttggacagtatatgtgagatgcagacatctgttaggatattttttcccttatttttttaaaaaagtttttgcattgtagttccaatctctccaatacgtgtcatattcacatgaatagctgtctttgcaaaattaaacaaatgaataaataaagccctgaagactcattattaacaagtgaccatttgtttcaaatattgtttagctaaaatagatatcccatataaactaagagttaatagaatcacaggggcctttaataaaattctgtaagaacttttgctggaaaagctgaatctcctaaaaatcccttcttttgatttttataattcataaattttcttttgatttggtaagcaaacattatcatttggtaataattattttgaaaataaacatttttattacatgttattgaaaatatatgttaaatgaaatgcctatttaaataaaactaaatactgtactaaaaactggaggcctattttatgtgatttttttaaaaaaagctaatttgataaaacattttatactatattttcagtaatatctatagagaaatagctgcagtaagttcaaataacattttaaaataaactagtttgactgaaaatatttgcctaactttattaaatgaatctattataatgatacataagcatttttaaatataaatgaaatgaactaagaatacaattattactgaaaagcaagtgacagtaaaagaagctatcaaactttacattgtttgaatatattgaaccgcctcttttttgacttacattgttcaaatatattcaacagcctcttttttgctgaaatttcttggcaagagttcattaataagtatgtgatgaatgtaaaataagaaatattcaaagtgccatgccttactattttacatattggcctattttataattcagagtggtgtttggtttattcaggctgctattaaaaaaaaaaacatgaactaagtggtttataaacaacagaaatttacttcttataattctggtgactgggaagttcaaaatcaagtttgctgacaaattcagtatctgctgaggcctacttcctaaatcataggtggccatccttctaccataactttacatggcagtaggaaagagaggactcccccttttataaaagcagtaatctcatttattgggggctccatgatctaaccaccttgaaatgctccacctactaataccattgctttgggggtaggattttcatatatgaattttaaggggatataaacatttagaacatagcagccatttttatcaagtagtgtttattatacatcatgaaattcatctccattcaagacaaaagagaactatgtttctgtcactaatttattggcataacttattttattgcaattcacaaatattgagattttttttttgcaaagggaaggtttgtgggaatcctgtatcaaatatacttatcagtactattattttttattattttttttgagacggagtctcattctgtcacccaggctggagtgcagtggaatgatatcggctcactgcaacctctgcctcctgggttcatgtgattttcctgtctcagcctccctagtagctgggattagaggcatatgccaccacgcttgcctaattttcgtatttttagtaaagatgggattttgccatgttggctaggctggtcttgaactcctgatctcaaatgatctgcccacctcagccactcaaattattgggattacaggaatgaaccactgcacgttgccttatcagtgccattttttctaacatgtgcatacttcatttctctgtgatacattttgttaattctcacaatatttcaaatgttttcattattatatgtgttatgttgataagtgatcagtaattttttatgttactattgaagttactttggggcactattaatcacacccatacaagatggcaaacttaaataataaatgttgtgtgcgtctgactacttcaacaactggctgttctctagctctctccctctgctaaagcttccccatatcctgagacataacaatattaaaatgaggccaattaataaccctacaatgacctctaagtgatcaagtgaaaggaagagttgcacatgtctcactttaaatcaaaatctagaaataactaagcctagtgtggaaggcatgttgaaagccaagagaggctgaaagctaggccttttgcaccaaatagtaagccaagctgtgaatgaaaaaaaaaaaaaaaaacttgaagaaaatttaaattgcccctccagtgaacatgcaaattgtaggaaagagaaagagaaacagccttattgctgatagagtgaaagttttagtaatctggatagaagatcaaataagtcatgatagtccagttaggcgaaacccaatctagagcaagaacttgactctcttcaattctgtgaaggctgagagaggtgtcaaagctgcagaagaaagtctgaagctaggagaggtgggttcatgagttttaaggaaaaaggctatctctaaaacataaaagtacaaggtgaagcagcaagtgacaatagaagcagcaagtgactgtagaagctgcagcattattcagaagatctagctaagatgattgatgaaggtgactacactaaacaacacatttccagtgtaggtaaaacagctttctgtcagaagaagatgctatgtaggactttcacagttagagaggagatgtcaatgcctgaattcaaagcttcagaggacaagctgacactctggttaggggatgatgcaatttgtgacttgaagttgaagccagtgttcatttaccattccccaaatactaaggcccttaataattatgctagatccagtcttcctatgctctataaatggaaaaacaaagcctggataacagcacatctgtttacagcatggcttactgaatactttaagcccactctttagacctactgaccaaaaagaaaagattcgtttcaaaatattactgtgctttgacaatatagatgatcatgcaagaattctgatgggagatgtacaaggagattaatattttcatgcctgctaatacaacatccattctgtagcccatgaatgaaagagtaattttgactttcaagtcttactatttaagaaatacaattcataatgctatagctgctgtagatagtaatttctctgatggatctgggataaataaataaaaatccttctggaaaagattcacaattctagatgccattaagaatattcaggatttatggacagaggtcaaaatatccacattaataagagtttggaagaagtttattccaatgttcacagaagactttgagggattcaatacttcagtggaggatggaactgccaatgtggtggaaataatgagaactagaattagaagtggagcttgaacatgtgactggattgctgccatattgtgatcaaacttgaatgaatgaggaattgtttattatggatgagcaaagaaagcggtttcttgaaatggaatctacttctggtgaagatgctatgaccattgttgaaatgacaaaatgggatttagaatattacataaacagttgataaaacagtggcaggatttcagaagatttacttcaacttaaaacaagttttactgtggatgaaatgctattaaacagcagcgctataagataaatcttttgtgaaagcaagagtcaactgatgcattaggaaaccaaaaactgtatgactcgctttattgctatattcgctttattgcagtagactagaatcaaagccacaatatctctgagttatgcccgtattttaacaattttatgaagtaaccaatgcgaacttaaaacaagatgaaaataaatttttcctacacagaaatgaaactatgttagtgtactagctaattaattatattattagttagtggcataaatctcaagattatgagaaacttgatagaactgacctaagtagagctaactgcccacctcccgtgggaaaaaaagaggaatcataatggctttcctgattacatttaatagcataattctgactgggaattacactttgcactacttttctttgtcttttttgagcagagcaggacctgtactctggaagcatctgactggaatgaagaatgaggagagaaagcaaagatcagttgttgacaggtagattaatttatagctgtaatggaataagaaatgataaggggaataagtaaaataaataacccaagagaatcaagatttaaaaagtcaagcaaaacacttattgctaacatataataaagataaaggactgttagttatgcaagagaagtgtttaagcaatatagtctcctgaaaaataaaggatattttaaaagatatactattgtatagattaattagccaacatgattaatattttttaaaattcccactaagttattgtgagttggacaaattatttttagtagatgataaagtaaataatattttcaacattattctgggatgtcaccacaataagtgatgcacaatccttggagacactaccaaactctttgttccaggtgatggtgtataatagaatctccttccagtaaaataagtgacatccttttagtcctctattgctaaatttttttaaaagaaaaggaaagaaatacagtaagactttctactctgaactgggcaataataaaaaatgtgctgcaagttttttctttccttctctataaaaaaaatggcaatgcaaattttattgttatttcaacatgccacaataatgtacaatcattatgaagaaatgatctcagtttaaatgctacttccccctttaaggcattaaaatagcacagaaaaatttcagaggaatcaagttaaatctaggtcatcaacagaatatatggctggtttcatgaaatggccccaatttgtgataagattgatcatattttaaattagtctgtagcctcaagataattctccagaatgccacaataaatatatatgtctttatatgctgtatatttattgtacattagtaaaacatgaattattaaatacatatttctataaatagcagctgcatttatattacagcatgtctgatattagctaatatcattgctttaatatagctgtattaatacatatactttgtgttcctatctccttcatattgaagaatgatgtaggtttatatgttgtatatgctttgttatgttttatggtgagacaatataagaatatcaagggaaaaatatgtttaaaatcattagcaatgtcaaactgaatgagaggacacattctagttttataaaactaatgatttctcaccaggcctaagactttaatagttgagatgtggtttgtcatcttccatttcatttaaaaatactttggaaattgtccatttgagtgagttaagataaaaaaaaacctttgaggcttaaaaatacccttaatttaaaactggatatcttaaaagagaataagacttttcaggaaggtactgctctcattttaaaacaaaacaaaataacaaaactgaggcccagatttaagtcgctgtaattcaatcataaaattcacttagaaaaggtttgatcaataaatcaataattatagaatttgcctaaggttataaagcctcggtggatgagcaattcattcctatatcacataattattaagcattgattttaatccaggcaatatactgggttttatagattcaaagataaataataaacattcctggctttcaagaactgacatgagaaaaagaatacgtaaagctactgaattagaatgcaaggtaatagagaaacccaagaaaacctaaaacttaagtcatattttgtcatattgctctttaaagtccttaactgacttccctctttttagagtaaaaatcaaagtttgtatgatagcctaccaggtctttcatcagctgcctctatgccttctttctgaacaaattcacttttgttcatgtttttttcactggagccacccttcacctccatttccatttcttgacagatcaaacatgcccttcttaccttcttctaaccacctggcaaaaatcatcatttcttctcttactatacccatatattttatcatattggtcaggtaaccgaagcatagaaagatgacataatttcctcaaaattatagatcctgtacatggttgagccataatttgcatacgggagtctggtttcagatccaacatcttaactgctttattttaaaccattttgttttactgcctcactagtaggggaatccaaaaagaaaagaaaatgcagaccatttttaaatggtttctctcaagaggtttcctccttggctttgggttagaagggaataattggatacaaaatggagggagagggggttgtaagtgacaatatggaaaacagagtttggccaagcttagaactactgccagatgttaccagtggctgtgtctccaaagaattaaaaaccagtaatatgaaagtacctcactgtaggaagggtcccctttttaaacgaggcaactctagatttcaataagaccaggccacaatagtacttgtagcaagagaaatcaagagaagagaaccatgccagcattaatatctttcctttccctctacaggattggcttaattagtgggtgtggcaaatgtaaatataatgattcagtaagcacaatcaatgttacactattcccatttttaattatgtatctctgcatggtacctttttcatgttggtcagcccattaaatcaaatatttaaacaaattgaagatagcaacaaagttttgaattactgtagtagaattaattcaaagaaaaaaagggaagacaaagcaagtttaattatagtgtattcgtgaatcaattataataacttaaatatgccaacactttagattactaataatgcaacattaagaatcatttatttactgtgttgctttttattctacattttatgtgtatgtttataatttaataacttctattagtaggatctgtcatgcacataatttataaattacatgtattttggaaatatatgaacaaaaccttgtattgaaaggagatcaaaatcaaagaagtttgaaaagtgttggcagaaggctgactaaatagggacatagaatcaattgtaattgagtcctaatagagacacattcaatctatatagatatatatgactttgaaaatgattttgagtgcttttaaaacacttaattgtattataatttaataatttaaagtagttatctcctatttgagttgatagatatcagaaaatattaaagattttgtttataatttaaacaaaaactgattttgttgattgtatttatgcttaaccttaataaagtggcaacttctgagtgaaacccaaaatacagttctaaaataatatttttgtatatgatttgtacagaatcgttacccttcagctgtccagtaacaacatttaaatctatacaagaaatctttgaaaataaaatccttatgatgcttgtcagtgcctgagaaatggatgtcaagcataaatctattaaataaatagatatcatggattaaacggttcttattttataacattatgaatttcatgtcggttttatttttcctccacactgatattctcgattttaaaaagataaagcgttcatattacgcatcatcttttgatttactcatagagtaccactgaataggaattagctttgaaagaggtcatctatgggcaaaatgtcaacaggattgctacactgcctagacagaataatgtacaatatgaagtaagtgatttaattaactgaaactgtctcagtagagtgcacttcttatctagtgaagacataaaaaagatagataactgcattatgtcaattaatctactcatatttcagggtgaatataagaaatgcgggagcatatgagctatttgtgtcaggataaatagataataaatatatatagcttcactcaattgagtcaatacaaccagttttccccccacacaaaacttatacttttgatgtttccactcataaacaatgatgcttccaacataatatttttaaaaactcttattacaatttttaaaatcattatttaaagatatttggatactattataaagcccatttaaggatttctcctactttttacttctgttgtactagtatgtgttaatggggttactatgaagtggatatgctgatttaacaacaggtgctgaacattttcttgatgaacattttctaggtaattttttttttctgctaagttttaagactcaattttgtggttatttctccctgttttaaacatggtgagataatctcctgtacgctagtccttaaacagaaaagtcataaaaccatgagtctaaagaagaccagtctttggcacaagtttacatgactttgtagcatttaaccaccaagctcttaaacacctggcatagagcatctttatttagcaaagtgaggaagcagaaaagtagagcgctgtctaaagtaggcagagactactcaactccaggaatcctgtttgtattagaatcccgtctggaattacgagatctgattattcaaaagaaaatgaaaatcctgattcttatatgatgaaatgtgtccattattaaattttgaaaaatgattcaaacttaaaacattgtagaccaactaatgaaaggcaaactggacttctgaggtcagatatagtctctgggccctccagataaactacccttgacatctcccttccaatcatgtagaagcagagatgaccccattacagactgattctcccattggatggcttttcttctaaaggagcagagaggttaccaaactatcaactgaaaactaaaagacatatgataatattttccacaccatttttgtgaagaaggatatactgatgatgactgtcttggtagtaagatttgaaattactttttaaaaaattttaattgtatttgtccatatctttttaaactgcctacaaaagaacatgtattagtttttcactcagatttttaaatgttattaaataattatgtaaaaattaaaaaaggaagttcaatgctctgtaatcaattttcgtgtacaagaaaaacaaggcagtggcatcatttgaaaataagaaagaattagctagctatacattattgatagacgagactattttaaattgtaaatttatttatgatgggtttgtaatatgtcctacccaataaagacaactgaactccctctgccttacagtgcagccagggacatatcttcttagtgaacttatttctgtgatacgatccaggttttattcttatccatccctccagcagccttactgtagcaaaatcagtttcttgtaacagaaataaaagtttctttcttagcttccggaaattattgactttcaagaatttttgagattctgcctccctttaacaaagtacaaataaacctctttttaacattcagacaatctaaaaacttgctgaaaatcagacaatgaatacctattggagcctcccttgacatatattaattttctggtacaatcttttgtaaatatttaataattagctcctgttttatgaatatgcagatgtaggacaagccttatatgaataggtcctggttgtagcaattgaactgatgcaatcacatgtcatccctgaaaacaaaagcagatgccactgaagaccatccttgtcaaaatatttccacaagcctgcgaaaggtcttaacctatacaaatgttatgactttgcttagggctgtaatttcttctttttgaactcaagtaacaaaaagaggatttgtcagttgaatgaataagaagaagtagcaaattatttggggatctgactaattaagcctatcaggaagtacctcaggcagtgtcattatttgtttagctaaattgtcagtctagacaatgagggagtaatgccttattttatttttcctcctctatgatattttgctcaactgcatattctaagctgctctagaagaattcacttagaacaattctatcttcttttattgaaattaagtcaaactctaagtgaggtctaaaaataaatttaaaaaaccttttttacaaaaagataagaataacagtcatatagtgactgaaaaaataaatttctttaaaataaagtctgatttaattagggttgttagacaaactattggacacaatatgagtttcagagaaaaactgattcttttactataaatatgtcccatgcaatatttggacatctgtatttttgtttgctgaatctggcaatcttagactgaatttatgttccggagaaagtgtagagtaagtatgtttaaaagagggttcagaagatttgtataaaaactaactgtggaagtcggcctcagctctttagatatatgcctgttctgccacaactgtccagcagtctgctctactcagctgcttctacttatcacgttttccagaatccagctacgttctgtcacagctctccatactcatatctcaatgtttactgagaccaagttttgatttatcattatcatatggaagaatctatatcagataacttttttaaacttgtttattctatttctcaatattcaagcaaataaagggttttgcaagcctatattcccatccacaaaggaattgaggtataccttaatttccattataagaaaagaataacgattaaaaaagaatatagaaaaaaagaaaaacttttatcagaaggtgccaggcttattattcaaagaaatcttgtttcatttcctttgctacatctatcttttttctataattttcatctaatgtagcaaataaaatatacacatatgtaaataacacatacaaattcctatgtcaatttattgtataaatatcactcacagaaaggtgaatgaaaaggcagtacaaaataaattcactttatttcacaattttaacttgactgccttgaattattggaagatcctttaagatgtatactgtaaaggcagtcctatgcaatttttttttttctaatacttcatggtgtttcctgcaatgtttcccagatatctacacaaaaattataataatacttactatggtttgtttttactttttgtttctatgtattaggttcttcattcatccaattgtctcctcttagaaacaattataagggccaaattacagttagactaatacacagtaaagttaaaatgttttgcacattatatttcttcaccatttcatactattaattttaaattttagttaaaattgatgtattttagaaatgtttttagtttgtctcagaatatatatatatatataactcagaccaaaaattctagtgtagttgttctgtctattccatttattatatttaagcctaaagaaaaaccttggtggcaaatgacagaaatctgttgattaagctcattgaattggcaaaccttaagaagagagtactctctttttccattagaacatcacctttctgatggtaaaagtgcagtaattgatactgtttgggagaagtgactagaggtctatatccttaggaaaagatttcaaaagctttggattctgttatgttttattatcaatatatttagaattctagttctaaattcccttcaactccagttattctggcgacaagcagcttttacttgtatttcaatctctgtggctaagtcctatcacctgttagcagatgatttccggaatcatcaggttcttgctacacctctcagtgcaagcttccatgcagataagcattggctgggtgcagaatgctgcgtataaaatgcttagaaacataaatcactgtggctatgcacagtccaatacttatgcactatggctctgcaactgaattctctgtgggggatattaaaaacacagagtctcaacctcaccttctattcactaaatcagaatccccaaagcgggaataccaaatatgcatgcagtttataactggcacaggtgattctggtgtattgtagagactctgaaatactgatttgctcttggaatccttgtccttccttgttttgtgagtcctgtgggcagctgaactcaaggtctgatactttcagaggtacagcatatgtaggacagaaagggaatcttgggggaggcatgacttgtgctgtatattccccgtgtctccttgtgaaacttgcttcacttctatgaacattacatttttctctgtgaaatataccttctatgatataccagtgaactataaaagacatcctggaaagacacacctcagaacaaagtgggatttatattttctgaaaagcaaactagtccttgattgtatatagtaataagaatttaaaaaagcatagaattggtaataacactctaaacccacatgtatgtgtaaattcattttcatatttaatacacttgtgtttaatatagtgttatatttaatatacttattgtattaaatatattatgtttaacatgatatttaatatactcatccacatttatatccacaccaatcccattggtctcttttgagtttttgtttcaggcttttttaagaatgtagggcaaagttttggtcttggtcttttaagcacagcagctacaggaagggagattttcttgctctgagagggcaaaaaaaaaagaccagcaacttaaaccaggggaactgacctaaaaggctgtgccactgataagattcacttggacttagccagattagaggcttgatacctggagagagagagatcaggctgaggtgttttgctttgtgtctatcagatgcagagcatttcagcagaaatgcagcaatctcacagcaagccttaaaaggtggcccaagagcctcagcatccgatgatatcatgtcaaacaaatgctatcatgtcaaacaaatgctatcagcatctgggaaatctctggaatctgggcatgagtatagactctgtgagtttcttactctatgaaaaaatctaaaaaaagttaaaagacgtacaggtaaacacctgaccattcatttcttctttccttcctttctttctctcttcctccttccctccttctctccctctttctctctctgtctctcactcagcaatctgcaatgtttcaggcattgtcataactcagccttgaggatataataattttaaaaaatattatagagcataacctcatcctcaaagaattgacattagtggttaaagtaaataattaaaccctgacaaaatattgttaagagttagcagtcttcataataggtattttattttgtactttcttcaaagttttcatgtaaaaatataagcttatatattatttgatatgaaaatatattaatatcaaaacacatgatcagtgaagaaattatttttaacacaaaagtgactgaattacagctcacttccatacacttgaataaaataccctggcttggcaaatcagtgtaagagctttagttcaactcagagaaacactaggtgcaccatagttaaatcattataatcataataaaacatggtatatatctattaatgccttgtatgggacaggcattatgttatagattcaacataaagtaaaatacatgaagcattttacatttaatttgtgtaacaattccacagagtacctgctatgaatatgtttattattaaaattaactgactgaggcttagaaacgttaaatgacttgttcaaggtaacacagctggtgaggccaaagctatttatcccaaaggccctcttctcttctataagcagacttttggttttaaagagcacactacaaaatttaaccctactgtagtcaagatgatgccatagatcattctctatcagttcaaatcaaggttcttcatcaatttacaggaagaggctatttactggctagctgtaatatatatatatatatatatatgaatatatatgagaaacaggaagaggctatttactggctagctgtaatatatatatatatatatatatataagaatatatatgagaaacatgtaatacataaaattataatatatattatgttataatatatcatatattttatatttaagaactatgtaatgtataaaaattatattatttaatttaaattaaataaatataaattaaatataaattaaatacataattataaaaattatattatttatttttatacattaaattttatatcttacatatttcttatgtataaattataatataattttatattatatataattgtatacattatatatttcttataaatataaaaatatataacatagaatatatattcatacacacacacacacacacacacacacacacacactcacacacactataaccaagacaggtttattgtaggaagtagctggtttcagctcaagagcttgattttagaaaggtgttaagctctatttatcgtaggatggttggcagaagactaaagaacagagatacacatattctctatttgtgtaggtacacacaaatgtacaggcatacttgcacatgtgcttgtttacacatgtatctatcaactcccaaatcctaaatttcctatttattttttacttttaataaactacctacagacaaatgaggtggttagaaataaacagggacttagaacacaatggagttatttactgaggctattaagttaataaattgctaaaatcaatctgttctgaaagaaagtgtgattttatttctctatgaaccccttaaatgcatgatatgaacacagtgtacacaacacagcggtttttagaaccaatttttatatggtcaactaattaaaaatggtatctaaatggcatataaaatgttttctaggaaaaaaagtggaattcctgtagaatgtaactattgattgatttctcagaaataaattgtgaagctcagagatgagtcccatttatagttatgtaaatatcacaaataataacggtaaagtgcagtgtttgttttgaaatcagcttaatttgtctcataattctttcaaaataaattcatttctttatgcactttggctaatattggaaatggaaatagtattcaatcagttctaaatcattttttaagctagataatttctggaaagtgctgacttttgttagaaaatctgaaaatggaaaattcctctcagtgatctgctatgtcttcacatattatttatgaagttaatactgcttcatggatttcttaaatctcaaaattcagccatctgtaaacctctcttctctgtaatgaatcttggaataagaaagaagagaaaatatgttttagcttccagaggagatttctgaagtccaaagcattaaagctcacatacttgtttactcaggtgaatcaacaagtctttttctcaggttctgtttgcttttattttgcatgtaatcctgataaatttaatcagtttcagagccatcataggttcaaaacaatagtttaaaagggaagaaataaggttgcttcagataggcatagtaactatgattaaaactgacaattgagggggaacatattaagataattatacaggtcatcagatgagggaatttaagttctattttagtcttacatcatacagggaaaagaattccataatctagtttattgtagaaatgacagaaagctgacctctatcatagttaaccatagttataaatgtaacattaaattatgttcaataaattcttaaagggaagattggtataataaaaagtagagatctgagtaatacattgtaggcagattttattctatataaacatagcaggctgtttaaaatgggcatgaccaaaaaactttattttgtgttacctagtcactgcagtgcctcttttaacaataggttttgaagttagctaatacatcaaggtttagttcaagttttggctacataataactactgatgatgttgcagcaagagatttaataacagatttaagtgaaccttttggatatcataataatcaatcagtcattgattatttttaatatgctcataatgatttcaaacattatatccagcctctaagagaagctataatttcatgtatggattttctgattagtaaatgccaatacatagggagactaacacttcactaatttattacaatagtgtggagaaaaccatatattattatctctcccacaaaagaattggaatagaataaatagactttattctgcttgtcttaaagacaaaaacattaaaaccgaaggaggaatccacaagaaaatagtacttaatgaaggaaagatgctatgaaatatgctgttaaaaacagagaggatgaatcagttttatcattttccaaatttttcagatcatccattatttcctctttaaggtactaaataaattgtgaattatcaatacacatgaaatagaaatctctgtgctttactcagaatatcacaggaatttagagctagagagtgctatctagataactagttcaatgattttcaaatagaagtacacatcaaaatcacaaggcgttataaattatctaaatgcctggacccatcatctgaatcagaattttaagcacgtgtcttttcaaaagcaactccctattttagaacaattgagtccagctcctacattttatggaagaaactgataaacaaattaaaatgtctaataataggtatttgcttatgcatattttgacactaaaataaaaaggtatatagtctttaatgtaataaaataaattggtatatagtaaacttgtatgaatactataagaagttttcatttcgttttatgattctaataaattggctagttgtgaatcatagaacaaattcatgtcaaagctagacaatcttcaaatgctgtctctgctcttttaagttctctaagcttacaagttgtttaatctaataaaaataaaaaaagttaagaaaatatttattcttagaagtttaacattttagactaaattccatagaaaccattacttaaaagcaatattaatataaaatatatccatttaaaggctatatataagagctaagatatttcaggatggattaattttgtcacactccaaagtatctgagaaattaatgagaactaaatgtgcttttgtctctctttttgctacaaaaattgaatttttcctttctttaggcatattcagatggctgtttgtgttttgagaattctggaactccggagctctgatatgagtcagattctctgtgttaatttccaacaaatgtgattaagcaaatctttatagagaaggaggatatgaaagaaatgaaggctttagtatttggacagagagcagttggattgattccgcactgatggggagtttgtattcctggagaaagaagagaacctagaggtttttgtggttccaacttggtatactgaagggacaactgggacctgaccactgattagctaagcatcatgcccttgaaggcaagggtacagagaaggtcctgggagccacatttggtatgcaaggattgaaaccatttcacagattaacatatttttgaaaggagcatggagataccatataggcattttattaggagccaagatgaactgtatagcaaaggctgttccccattaattctggattgatccacctccagtgtttactcaaatcccaagggaaggaaataagcgactctcaaataattgacatgtaccacattttcttaatccagtctatcattgttggacatttgggttggttccaagtctttgctattgtgaatagtgccacaataaacatacgtgtgcatgtgtctttatagcagcatgatttataatcctctgggtatatacccagtaatgggatggctgggtcaaatggtatatatacaccatggactactacgcagccataaaaaatgatgagttcacgtcctttgtaggaacatggatgaagctcgaaaccatcattctcagcaaactaccgcaaggacaaaaaatcaaacctgcatgttctcactcataggtgggaattgaacaatgagaacacatggacacaggaaggggaacatcacacactggggtctcttgtggggtggggggaggggggagggatagcattaggagatatacctaatgttaaatgacgagttaatgggtgcagcacaccaacatggcacatgtatacatatgtaactaacctgcacgttgtgcacatgtaccctaaaacttaaagtataattaaaaaaaaaccaaaataatgaaaaaaaaattgacatggattttcaaccatatggtggatgaaagtaaaggtagtttttttttttttagaagacatataaattcagtttgtttttgcatctgaatgtttgggggaaaagttaaacctgtagtatacgtgtgtgtgtgtgtgatgtgtgtgatatttatatatatatatttatatattgcagagttgttccttccacattagttctactgcactatttttgtttcccctgctgttatcaaaaataagcattcattattcatgtaagataaagaggaaaacgaaactaaaatgagaggggaaatactagattaatttgatcatacatatttaaataaccacaagaaatagttattctcaaatatacataacaaagttacactagggaatagatcttactatacacattcttaacatttgtattttattatatgctagactttcaaaagattattttttcctcctattgttttcttagatttactgaaccataaagaaaggaaaagaagaaaactggctcattgttacaaatcacttcctactgtggatttgaagtcttcttattttctgcttttcatctaaattcagcatcatgatgctgcaatacaatcaaaagaaaatgctgtaaatataaaaatgttaatttaaagctatacacataccaggttcaaagaagatgcaagccacatgtcagtgggattgcctgggttcatctggacagtccagctcatacaacaagcaggccggtgactctttaggcaaatgcgaatgttttatagattaaataaatcatctttctgtttttttaaggttattaaatattctgcagaaaaatccaactctgtgcctttctaattttctcttccacttcaaatccttcacattttatgttttttcttttaccaatgagttagtaaaagcaagtaaatataaaactcaaaaaattatgtattatgtctaatccaggctttattttaaaaatatgaattttggctctttttatatgacttagtatctttgtactatttttgttttattattatagaatgcattgttttccaatagtatactatttattcatacacaaaaaggcaatatttaacaagacatttgagcaagaaagcattaactcaaaattcagggctcaagcctacatatattccatcggaaggaccggccctttactggctcctgggagataacctctgaatttggaatatcctgacagataataatgtctttgatacctgagacctcgagctgtgccaaatagtttatgctaattagatgtgatttatgcttgcaaccctttttttgtatgcctagggctttggggcatgctgcatcagcttggcccctgcaggagctggagactgattagctaaggtcagttatgcaggtgcttcatgtcatcatgactgacctacagtgaaaaccatagacaacaaggcttatgtgagcttccttggttggttacactttatatatgttgccctacattgtttctgagaaagtattttaagtacttttcatgcaactccaatgggagaatacacctggaagactgtacctgctttatcttagactttatcttatgtgtctttccctttgctaattttaatctgtaacttttatagtaataaatcctagcaaaaagtaaaacagtttttctgagttcttcttatacattatcaaacctgagggtagtctttaggccccagacacaatatctgaaagctatgaaatgctttgagctttaatattttaagcaatttgtggtctccataacaccatttcttggaaggatatcaccagtatgatgacatttctgttcttgaagttgatatatgacttacagttaggagttagataatttcaatagtctccttatgttaaaatatatttaaaccagttaataagatgagaactttatctcttcttcaactttgcttctttctgcttcccccccgccccatattcttattatcacaatttctggaaacaggagtcaagattttaaactatactacagttagttggaatagcttcttagtggcaattcataaaatagataaatgagacaagaatatccttggaagttctgttatttggtataaggcaagatgtaaagttgtactccttgacttgtcaaatgactggcttaatgtcccacagaatatctgtggcagtgtcaggtctgaaagtggaatcttatattacaggtatggggttctttcttctgtaataaactcagattattcctgaagttactgccaaaatcacaacctaaaataaagcgtaattacattatggatgtgtacattagatgatttacctgcaagtaaaaggaactctgacttcagtaatattaaacaagaggccataaggatcaaatatattaggtccagaggttgggcaggcaacctgagaggttcagtcaagagttcaacagttgaccacaggccagatttcttttatctctaatctctgctgttttcaggacactcactaataatagactaatagtttattatattattatttaagtagttaatagtgatagtctaatcaactatacccccccatcttgctttagggcctcaaaatggtaacagcaactacataaatccagatgttagaaggtataggagaggtcacgcatacttttcctcacattctaagagcaggcgacgaaatctttcctcagaaagaatgcctcccttgcctcagagaccagcatagtgtcacatgtccacttctaaaggaatccccaagagtgggatgtgattaacatgactgccttagataaagcatgagacatggaccaagacaaagcaaccagacaaccacaaatacttgaaaagtggctagacaacctctggagtaactctgtttctggtcatggatatgtaaatgcgagttacagttattccattaggtatctgcagtccttgtgggaaaaaacagtttgccacaaatgttccttctattgtaaaaacaatgtcagtgcactgacagtcaaaatatgtggtggctgaaaccatattttggcttttcaaaggtttgcttttaaagctttgttttctaacttcaacaagtatagtcttcttgcaaatatcagttctgttgttaagtaacaaactataagcctggattagtattgtagccctgacttgtgttgtatgttgcttattttctgaagccagtcagtgagtgagtccaccttgagtaggtgtttttatgtcaggctttgtgagaaatgaggagccggaggggatcccaaatcaattgccaaccatgtcacagatcatttaaggcagaatggaacatgcttgtgacaaaggtgatgacaaatgaatatgtactgaagggacaacaccaacagatgagtgaaggaaactggaaatatgtaatatgagatggaggtcagagtgaaatgtaagataatgataatgaaatacatgtgtgaatgtaataccatgagttagataaaaataggtggccgttaagactcacacagtgcctttcagaataaattctgaaattttacacaaattcaatattgccacaagttgtgaatccaataagtgaacagtttgttatataatatttaaaccaacctgtatagagtggagaatagaacatgttttactacctttaagttaaaaaaaaaaagttgcttgagtttctgttttctaaccttgagaagtaagcatatgtaatatatatactaacctaacacacaggcaaaaactcactctatttgtacataggtgttaaattatattagtccacatttaggtatataaaaagccagtggatactaacgagatgcaggtctttgcaggtagaattgtgctcacaggcattcaggatgcagtcatcaatgtcctgttcacatcttatcccaacatagcctggattgcataagcaggaaaagccatcaaccactggaaacaacagaaaagagaaaactcttaacattcctttaaccttagtacaggtaattataattagtctaaaattctataatcatttatgtagttcacttttaaccaaataaagtaagaattattatatttaatcgattacatagtcatctacaatattttctaaataaccatcttattcagttctatttaacttaaaaaaaaaacttcagttagttgaaataagaacaattactatggacatttggtaatagtttgcaaagcaacaatgaaaatatccaattttacttgctctctcttgtttttggcagtacacaatatatatgataaataggttactcttgtatcatttaattttcccaagttgttttaggtttaataaacaagaccttaactgttcagttgttaaagttctatgtatgacagaatatattaaagtgcattgtgatctcaaagttgataatgagctacttaagccttagttaaaaagagctttcacgtttcatcaaaatctttgtaaaataatgatcacaatttgttcttcattttaccattaatgatgaaaaagaatggtgtctgaagcatctcaaggaagtagtgacagtatgaattgcagttggagcaggcaccaatttataactacttgcagtcagtccctgagtccttcattatccctgagatttaccatgaaatctatactcccattatgcctctctgcatgtacttgctattactctcattaaatgcttaggtcttcagtggcaacagcatttttaatgcactgtaataaatgtatctagcttctggatttttgcagccatgttttgtacaacatgtgtaactagggcctctaaggagaacagggcagtcatagacatcaacaagagacaagtgaaatacacaagaataggcagctccttagacaggattttacttctgttttactttccttttgtatctagcacctagtttttaacctctcattgactacaaattgttaataaataaacagatgtaattgtaaatgaattaatgtgataaaatgtcagtctgtgcttctatgttacacatggtattttttattttaacatattaaaaccacatattatacaatatataattaagacattgtggagtgtcatcaatcataacaatatttaaaattatccttatggttattatttaagttgggatactgatgcatactgacaagtaacaactggagtcaaattaactttcagcattgatgttacgtgttctatgaagacaaattataaattacattaaacgcaaaggacaacaaaaggtcactttgaacaaacgaagtgtctggaaacagattgttaaaaaaataaagcatgcttttattgtcaataaatgtgtttctaacatagattaatacagacaaggaatgtgtttctaacactttattctggaataaaaattaataaatggactaagtgccagaagagaacctagagaactaaattggataccaaagggaaatcggatactgcaaagaagatagaaaaaaattaaatatttaaaacaaagtaacaaaaagtagagggtttttctcatatgtaatttgttaaccacggggctatgtgataaccaataaccatttcacaggaaagacatgttatacacatagtcttgctcttgattgttgttgttgtttttaacagaaaatctagtcactgtgatatggaagtgctggaatgggaagagtgtggtccctttaaatgatacagaagggggaagggaagtgctgggtagaggagggcgtggtccctggctagggctccacccccatggatctacgtgaggacggcactcctgcctttatgccagaatgttgcatttcccaagaccaccctgtcccaccctgcccacatcgtgtgcctataaaaaccccggagaccctagcaggcagacacacatgtggctggatgtagtgagaaacacatcaggggaagaagacacagtggcacctggacattgagaggcacacatcagcagaggaacacacaggtggctgcacatcaggaggaacgcactgacaagcgccggcacgctggagctccagaacaacatggagttttgccagggcagtcagaggggagcccaggacgccgagcaccccaactccaagggaaaaccacctcccttctggcttgcattgtctgagagctacttccacccagtaaaaccttgcactcattctccaagtccaggtgtgatctgattcttctggtacaccaaggcaagaacccaggatacagaaagccctctgtccttgtgacaaagtagagggtctaattgagctggttaacacaagccgcctatagatggcaaaactaaaagagcaaaactaaatgagcaccctgtaacacacgcccactggggcttcaggagctgtagacattcacccctatgcactgcggtggagtcagagctccacatcctgcctgtctatacgttccgctagaggaatggggcactgaagaagcgagccactccccctgtcacacaccctgcaagggggaaaaaggacctttcccatttcaactgcattggtattagtctgtgtttataaatatttcatactactattttgaggccaaattttcttaaaataggccttctatgaatctggatgtattattcattttatgcttaaatgtgtaccagacatcatatatactggttgtactgaatgaaagtttgtaatgtgacaaaactttttggtggaatatacagaggtattttaaaactgtaacagcaggccaggcaggtggctcacacttgtaatcccagcacttcgggaggccgaggcaggtggatcattggaggtcaggagttcaagaccagcctgatcaacatggtgaaaccccatcgctactaaaaatataaaaaaaaaaattagccgggcttggtggcacatgcctgtagtcccagctacttgggaagctgaggcaggacaattgcttgaacctgggagacagaggtcacagtgagcctagatcgtgccactgcactccacactggaagacagagcaagactccattaaaaaacaaacaaacctgtaacaacaaaatggtgaacaaccgtataatggtgttcaagatttacagactcacacacaaacacacacatatatgcagtgatttctcatatattgtcctgtaataaatactattgacatgctagagttccctgatccctctcgcaggacatgcgacaggggtgtggctggcctgctcagttgccgcagctgctgaaaccccttgagggagggggaccacgcagataggcaggtgcagaggccagggcgagtgctttgggctctggacctgtggtagtgtctaggggtggatgcctgcaaccccagtgttacaatgctctcagccttgctgtccgcagatggctttaagggttaaccagctgaatggaccctctgccttttcacaagggcagaaggccagtatgatagctatctgtatcctgagctcttgcctagcgtcccggaagattcgggtcacacatgggcttgaaggttgaatgagagatcttgagtggtggaggtggctctcagcaggatggatggggaagtgaaagcaggggatggagtgggaagataatcttcccctggagttgggccgcacagtggccaaactcctctctgaccactcccaaactcctcttggtattcagatgttcctcctcttctctctttctctgcggaagagtccgttggtctgcctgtcttacctcttcaacttccggttcactctggagtctgaggttcagcatttatctgggtacgggctagggagcatggcaagccaaaaggcaactttttgggtggaaaaacaggaatgcctgttctcatttatggctacgggtatccaggcttgaggatgcggcctttgccagggcatcttgtaccttcttctacccagtatttccgtgtcttctgtctgtattactattaactagaattcaggaagtttagcttcccaaaccattttatttcagagaaagtatgaagaatctagtgtcttagtttcattctgataacattctacatgtgtgatataaattttaataaatattttggttgcctggtagctaaatatccttagatggggtccaaaatatattatgaatgattatattatgaaatacattaatatattaagtattcaaattttacatttcccataatatattatggtttcaaaattttaataggtagtattgcattataagtaacattataaattgcattttcatatcttagaaaaaatcatatattaaaatatttatgaagaacttttaaaagtcaaatataatacattgttaatcaatgtgaacaatttaaatttaaattgtctattataatcattatagtagggctgcctacatatttcaaaaacaaaaaatctctaacttctctctcagccatgcgatattttaaaatgacatgaatcttttttaagtatcattcctcaccagacacctgtgggtttgagctcagaaatgatacaatactgacttacttcaaggtaatttgagaatttcagaaattttaaaatacaatcttggaagtgccaaaatctggaacaaaaataataacttggtgatttatatcaagagcagcaaaaatatggcatatagtccacagaactgttttgctcagctggcacaatgttagaaaattaacgtgatattagtatctatacagatatttcagtttgctagggccccaccactaccttttatatctgggttcttttatatctgggtggcttcacccaatttacaaaattcaattgccttgatattggcttttatttgcacagcacttgttttgagaaacaaatttaaaatttgagttaaatcctactgtttctaaataaaaagacaataacataactttctattgaaatgaggttttatatgtaattttaactatttattcatatattgaggtgttgtgggaagtcagggaccccaaacagagggaccggctgaagccatggcagaagaacgtagattgtgaagatttcatggacatttattagttccccaaattaatacttttataatttcttatgcctgtctttactgcaatctctaaacataaattgtaaagatttcatggacaattatcacttccccaatcaatatcctagtgatttcctatgcctgtctttacttcaatctcttaatcctgtcagctgaggaggatgtatatcgcctcaggaccctgtaataattgcattaactgcacaaattgtacagcatgtgtgtttgagcaatatgaaatctgggcaccttgaaaaaagaacaggataacagcaatgtttaggaaacaagagagataaccttgaactctgaccgccggtgagctgggcagaacagagccatatttctcttctttcaaaagcaaatgggagaaatatagctgaattctttttctcagcaaggaacatccctgagaaagagaatgtgcacctgggggtgggtctctgaactggcccccctgggcgtggccatctcttatggttgagactgcaggcgtgaaatagaccccagtctcccacagcactcccaggcttattagaaagaggaaattcctgcctaataaattttggtcagaccggttgctctcaaaaccctgtctcctgataagatgttatcaacgaaatggtgcccgaaacttcattagcaattttaatttcacctcagtcctgtggtcctgtgatcttgccctgcctccacttgccttgtgatattctattaccttgtaaagtacttgatgtctgtgacccacacctattcgcacactccctccccttttgaaactccctaataaaaacttgctgggttttgtgtcttgtggggcatcacagaacctaccaacatgggatgtctcccccggatgcccagctttaaaatttctctcttttgtactctgtccctttatttctcaagccggccggcacttaaggaaaatagaaaagaacctacgtgaatatcagggcaggttacctgatactgagggatcatgtagaaatatattttaaaggaggtgagataaaaccaaataagatagttttttgcaacacccttctagacctttgtttatttctgtttctcctttttatgcctcagccacattctgtatataatgtcatttcgttttctgtgtctcaacaaaattacccattttaggcatgttcttccacagaaaaatccatgtttccatcttacttttccctctttccttcttttcttcctgtctttttcctctataaatttatatttttttaggaatataaatttcagtaggaagaagtgtgagtgtgtggggtgatatatgtataaaataggctaaactaatgttattttgaatactgtaaacaatgctttctcatgcctaagggtgaatatttttaaaaattctaccatttcaaataaaattgcaaaggttaattctgacactagaaaggaaaagtcacatttcattagatttcctcattcgctgcacttgtgactcacaaaaatataaatgaatttgtcagaaattgggggtacttagtgaagataactgacattgactttgatgttcaagccaggctaaagtcagtaaataatcatggttatatcctaaactctcccattactatgttacattctacaatggtctgctctacaataattgcagccgctgaaggaactcactgtcatagcaatatccatgcaggcaagggctggaactgcactcattgacattgatctcacagcgtggacctgaaaagctggcacactggcaccggaactcaaggggaaacatttccaaatccattttctctccacgcacagctccattctcacaagaatcactagctttgcaaggtccaaattcacagtgataacttggaaaagaaagaatcaaagtgccaatgcttattgaatgaaccaattcttacaactgctgtcattcacctggcatatttcagcataaaggcatccaatttattctctattctcttccatattatcattgtgactctctctctctctccctttccctctacattacaatttaagaaagaaatgttatttatgatttctatgcttcatctaacaaagtaccagcaggtagcaatgataagtgacagcatttttaaaaattatattttgtttcttcatacttcccacttcttgttcaacaatgttctctgaagacattgcaattaagaaagtagattattgggcaaccccctttgggtcccctccctttgcatgggagctctgttttcactctgttaaatcttgcaactgcactcttctggtctatgtttgttatggcttgagctgagctttcgcttgccgtccaccactgctgtttgccactgttgcagaccagctgctgacttccatcccttgagatctggcaggatgtccgctgtgctcctgatccagcgaggcgcccattgccactcccgatcgggctaaaggcttgccattgttcctgcacggctaagtgcctgcgttcatcctaatcgagctgaacgctagtcactgggttccacggttctcttccatgacccacggcttctaatagagctataacacttaccgcatggcccaagattccattcctcggaatccgtgaggccaagagccccaggtcagagaacacaaggcttgccaccatcttggaagcgggtcaccgccatcttgggacctctgtgagcaaggaccacccggtaacattttggcgaccacgaagggacctccaaagtggtaatgttggaccactttcgcttgctattctgtcctatccttccttagaactggaggaaaataccgggcacctgtccgccagttaaaaacgattagcatggccgctggacttaagacttaggtgtgaggctatctggggaagggctttctaacaacccccgacccttctattggggatgttgatctgcctggagccagcttccactttcaattttcttggagaagctgaggaccgactagaggtagaaagcagctgtcccgaactcccggcagtagccggttaagatcatggcacagccagaagtctctacccagcagtcgcccatgcgtgcacccctacctttccttctgacccacacctcctgggtcccgaccacgacttttttgaaagtgtagccccaaaattctccttacctctgaatctacttcctctgatccctgcctcctaggtactaatggttcagactttcatttcttctagcaagttgtatctccaaagggatctaaggaggctctacactgtgtccttaggcacctaggctataacccagggagtcttatccctgttatccctcctgatttaggtatacagctgtctacatgggcagttacgtgggacccgttccccaccacctgtgccagggccccaagtttgtaatggctaagagagagagacggagagagagacaaaaagggagtcaaagagaaaaagaaagaaaaagatattaatagttaaaaaaaaaaagtgttccctattcatttaaaagccagggtaaatttaaaacctgtaattgataattgccactttgttgtcagtgtaaataagggcttagcaaatccttaacccagtaacccacagatgggccaaatgcattcagtcagtcggtagggacaactgcttcactaaaagtagaaaagtaacttttagaggaaacctcgttgtgagcacacctcaccagttcagagttattctaagtcaaaaaaaaaaaaaaaaaaaagcaaaaaggtagctttctaactcaaaaatattaaagtatggggctattatgttagaaaaagctaatgtaactccaaccactgataattcccttaacccagcagatttcctaatgggggatttaaatcttaattaccatacaaaggtccgaccagagctaggaggaactcccttcaggacaggatgatagatggttcctcccaggtgattgaggaaaaaaccacaatgggtattcagtaattgataaggagacttttgtggaagcagagttagaaaaattgcctaataattggtctcctcaaaggtgcaaactgtttgcactcagccaagccttaaagtacttacagaatcaaaagactatctcaatccagactcaaaagttttgctacaccctctctgaaatgaatttgcataagaactgttgtttacaagaatgcatcttgatggggcagctgggttgttgtgaaatactcagaaacccagcccagctctaggactcaccctgagtgcaaaggcaatgttaggcatgctggtaaaggaccactagaatccagcatcctggatccctttttttgtggtcaagagaggcgggtaaaacagatgcaggactgctacataggtgagtgtaactaatcagataagcagaggtccatgggtggttacgcacctagaaaggaataagcattaggaccatagaggatgctctaggactaatgctcatcggaaaatgactaggggtgctggcatccctatgtccttttatcagatgggaaacatttcccccaaggcaaaaatgcccctaagatgtattctggagaattaagaccaatttgaccctcagacgctaagaaagaaatgacttatattcttctgcagtaccgcctggccactataccctcttcaaggggggagaaacctggcctcctgagggaagtataaattataacaccatcttacagctagacctgttttgtaggaaaaaggcaaatggagtgaagtgccatatgtacaaactttcttttcattaagagacaactggcaattatgtaaaaagtgtgatttatgccctacaggaagccctcagtctacctccctaccccagtgtccccctaactctttccccaatgaataaggaccccccttcaacccaaacggtccaaaaggagataaataaacaattaaccaaagagtgccaatgttccccaattatgccccctccaagcggtgggaggaggagaattcggcccagccagcgtgcatgtacttttttctttctcagacttaaagcaaattaaaatagacctaggtaaattctcagataaccctgatggctatattgatgttttacaagagttagggcaatcctttgatctgacatggagagatataatgttactgctaaatcagacactaaccccaaatgagagaagtgccaccataactgcagcccgagagtttggtgatctctggtatatcagtcaggtcaatgataggatgacaacagaggaaaaagaatgattccccacaggccagcaggcagttcccagtataggccctcactgggacacagactcagaacatggagattggtgccacaaacatttgctaacttgcgtgctagaaggactaaggaaaactaggaagactatgaattattcaatgatgtccactataacacggggaaaggaagaaaatcctaccgcctttctggagagactaagggaggcgttgaggaagcatacctctctcacctgattctattgaaggccaactaatcttaaaggataaatttatcactcaatcagctgcagacattagaaaaaaaaacttcaaaagtctgccataggcccggagcaaaacttagaaaccctattgaacgtggcaaccttggttttttataaaagagatcaggaggagcaggtggaacaggacaaatgggataaaaaaaaaggctaccgctttagtcatggccctcaggcaagcggacttcggaggctctggaaaagggaaaagctgggaaaattgaatgcctaataggccttgcttccagtgcagtctacaaagacactttaaaaaagattgtccaagtagaagtaagctgcccccttgtccataccccttatgtcaagggaatcactggaaggcccactgccccaagggacgaaggtcctctgagtcagaagccactaaccagatgatccaccagcaggactgagggtgcctggggcaagcgccagcccatgccatcaccctcacagagccccaggtatgcttgaccattgagggccaggaggttaactgtctcctggacaccggtgcggccttctcagtcttactctcctgtcttggacaactgtcctccagatctgtcactatccgagggggtcctaggacagccagtcactagatacttctcccagccactaagctgtgatggggcgctttactcttttcacatgcttttctaattatgcctgaaagccccaatcccttgttagggagagacattctagcaaaagcaggggccattatacacgtgaacataggagaaggaacacccgttggttgtcccctgcttgaggaaggaattaatcctaaagtctaggcaacagaaggacaatatagacgagcaaagaatgcccatcctgttcaagtaaaactaagggatcccacctcctttccctaccaaaggcagtacccccttagacctgaggcccaacaagaactccaaaaaattaaggacctaaaagcccaaggcctagtaaaaccatgcaatagcccctgcagtattccaattttaggagtaaagaaaccccatggataatagagattagtgtaacatctcagggctatcaatgatgccattgtccctctatacccagctgtacctagcccttatactctgctttcccaaataccggaggaagcagagtggtttacagtcctggaccttaaggatgtctttttctgcatccctgtacatcctgactatcaattcttggttgcctttgaagagccttcaaacccaacgtctcaactcacctggactgttttaccccaagggttcagagatagcccccatctattaggcattagcccaagacttgagtcaattctcatacctggacactcttgtcctttggtacatggatgatttacttttagctgccctttcagaaaccttgtgccatcaagccacccaagagctcttacatttcctcgctacctgtggctacaaggtttccaaacaaaaggctcagctctgctcacagcagtttaaatacttagggctaaaatcatccaaaggcaccagggccctcagtcaggaatgtatcctgcctatactggcttatcctcatcccaaaaccctaaagcaactaagaggttccttggcataacaggtttctgccgaatatggattcctaggtatggcaaaatagccagaccattatatacactaattaaggaaactcagaaatccaatacccatttagtaagatggacacctgaatcagaagtggctttccaggccctaaagaaggccctaacccaagccccagtgttaagcttgtcaatggggcaagacttgactttatatgtcacagaaaagaacaggaatagctctaggagtccttacacaggtccgagggacaagcttgcaacctgtggcatacctgagtaaggaaactgatgtagtggcaagggttggcctcatggtttacaggtagtggcagcagtagcaggcttagtatctgaagcagttaaaataatacagggatcttactgtgtggacatccatgatgtgaatggcatactaactgctaaaggagacttgtggctgtcagacaaccatttacttaaatatcaggctctattacttgaagggccagtgctgcgactgcgcacttgtgcaactcttaacccagccacatttcttccagacaatgaagaaaagatagaacataactgtcaacaagtaattgctcaaacatacgccacttgaggggacattttagaggttcccttgactgatcccgaccttaacttgtgtactgatggaagttcctttgtagaaaaaggactttgaaaagcgaggtatgcagtggtcagtgataatggaatacttgaaagtaatcccttcactgcaggaactagtgctcagctggcagaactaatagccctcactcaggcactaaaattaggagaaggaaaaagggtaaatatatacacagaatctaagtatgcttacctagtcctccatgcccatgcagcaatatggagagaaagggaattcctaacttccgagggaacacctatcaaacatcaggaagccattaggagattattattggctgtatagaaacctaaagaggtggctgtcttacactgctggggtcatcagaaaggaaaggaaaggaaaatagaagagaaccgccaagcggatattgaagccaaaagagccacaaggcaggaccctccattagaaatgcttatagaaggatccctagtatggggtaatcccctccgggaaaccaagccccaatactcagcaggagaagtagaatggggaacctcacaaggacatagttttctcccctcaggatggctagccactgaagaaggagaaatactgttgcctgcagctaaccaatggaaattacttaaaacccttcaccaaacctttcacttaggcatagatagcaccgatcagatggccaaattattatttactggaccgggccttttcaaaactatcaagcagatagtcagggcctgtgaggtgtgccaaagaaataatcccctgcattgcaggccatacatttcaatccctgtatctttaacctccttgttaagtttgtctcttccagaatagaagctctaaaactacaaatcgttcttcaaatggagccccaaatgcagtccatgactaaggtctaccgcagacccctggactgaccagctagcccatgctctgaagttaatgacattgaagacacccctcccgaggaaatctcaactgcacaacccctactatgccccagttcagcaggaagcagttagggcagtcatcggacaatctccccaacagctcttgggatttcctgttgagagggggaactgagagacagaactagctggatttcctaggccgactaagaatccctaagcctagctgggaaggtgaccgcttccacctttaaacaagaggcttgcaacttaattcacacacgaccaatcagatagtaaggagagctcactaaaatgctaattaggcaacaacaggaggtaaagaaatagccaatcatctgttgcccgagagcacagcgggagggacaatgatcgggatataaacccaggcattcgagctggcaatggcaaccccctttgggtcgcctccctttgtatgggagctctgttttcactctattaaatcttgcaacagcaaaaaaaagaaagtagattattaacaatttgatgctccctatattttctttctggtaccctggaggttgctatcactgtaagctctgtttgaaggatttgttgctattctcaaaacaagtaaatgatggaaaaagaacattgtaataaacatctaatcttaatagaaatacttcaatcctgaaaaattttttatattttactcagaaaatgtaattatataaagtggttgccattgtgtgaaatgtacacaagtatttaagaaataggattatttgattcaagagaaaccatatcagacaaaaagcacagtataagcagcacaaactttttcaacaaagcaacattattatttgagtgtcagttttcaaggcatagtaaaaatatttacatgttacctatttggaaagtacttaaaaataaggctacttattcactaaaatgtacagtacataggtacaaacataggttctaaaaacgcctggctgaatactttaaagcagaaaatatacagtcatcattaagtccttgaactgcttgggttttctcagtaatttcacaactacagggataaaggtataacacaaagacttaggataagggataaaggtttcaaagttgagaagtactatagttgtttgagaaattacaaaagccaagtgtccctgtgattctcccagttctgaccacaagaaaaatagtaagggggactgcctagaagctgctgaggatatcagcaatctgtagagtaaaggcagcaaattgatatcattagtgtccataaaataagagcaataaaactgtaccaaaatggagatgctcaggacttcactttccaagtacagcaaaaaaaaaaaaaaaatgaaaaaaaactacttcacaagaacataaaaataaaaatttccttcaataaaaaaaaatctatcaagtggctactttttgcaatagcaatgcttagtagtatagagaattcaaatagaaacaagatctttttctgaaactattatgagattgaaatgtattataagtaatacatttctggatactattttatcataatcaaagtttttgtgaaataatggaaattgcattgaacaaacatctactcatgcagaaaaaatgaattgtctttaatgaaaagttcccatgcataccctttctttctaattacctactgctaaatatttaattgtgacactaggtgttttgttttgctagtgggaagttaatttagctgttgctttgtaaataattttgtatattataatctattacatagctgaacaacaatgtatatgagaaaatactcatgatattttcttttgcagaacacacatgaattcactgtacccccatatcatgttgatttgtacatgaattcattatactaatatgtaatgagcccttgtcctgtggcaagcactgtgctagacgcgggaggtggggggcaggtgtttaaaagaacaatgatgggttcaaataggcaagtaaatcggtgcaataagtggtaaacatgatcaatttccttgctaaagagtcattatgtaagtagaattccaatatggtttccaagatccccaccactagtgtacataccccatgtaattccctcactttaaatgtgggtgaggctgggtgcagtggctcacaactgtattcccaggactttgggaggccaaggtgggaggattgtttgaggccagaagtttgagactagtttcagcaacatagtgagacccctagaggtggtgaagagatggtgataggcacacctatagtcccagctactacttgggaggctaagatggaaggatcacttgagcttgggaggtcaagtctgcagcaagctgtgattgagccactgcatttcagcctgggaaacagtgagactctctctcttaagtaaataaatcaatgtgggtaagatatgtgaatatgattgaatgtcactccgtaattgtttactttatatggaagaaaagattgtggatataattaagtcccagaatcataagggagtccatcaaaagacacattatcttgagtgggtctgactaaatcaggtaagactttaaaagaagtcagaggcattatcctacttgcctcaaagaagcaaatgaaagctgtgttttataaagctctatgagatagggaatggcatctggtttgcagcagccaagaacactctagacagccagtaagaaagaaagaccagagttctaaaatcacaaggaagtaaattttaccaacagccagtgagcttggaagagaaacgtgagccttagattagctcacagtcctggccaaccttttgatttcagtcttgtgagaccatgagtagagaactcagttaaaccattcacagatttttgacttgcagaaattgtaaaataaaaaatgtgacttgtattaaatctataagcttgtgataagttgttattcagcacagaaaagtaatacagtcaaatataagggccactaagacatcttcagtgctattggaaagcctactgaacaggtgatatttggagtgagccctaaggaatcatcacacattatcgaggttaggcatgtgggatacagaaggggatggggagagttttctagaaggatgagggccagaagatgagaaagttcaggagattgaaaacaaatcaatatgaatggaacacaaaatacagggaagaaggagatgcattaccacatttaaggaattataatatgccatcgattttaagggagtttattttatgtgccattaagggtagcatggtagaaaaaatgatgccctcccactcccttcactacctccctgttgaagatatccagctcctaattctggaaacctgcgagtgctatcttatgtggccaataagaatttgcagatttgattaagttgaggattttgttgtggtaagcttatcctattttatctgggtaggccctaactataatcataagggtcttccaagggcctttataagagagaggcaagaagtttaaaggaggaaggtgacatgaagatgaaagctggagtttggattgatgcaaggaaggggtcatgagcccaggaacaaaggcagcctctagaatctagtaaaggcaagaaaatagaagtcttcagaagcaacacaaccctgcaatacctacctcattttagactttggcctccaaatatataaaataataaacttgtgcagttttaagtttgtgaaaattagttacagccattataggaaactaataaagagagcaaaaactgccagttaaattctgataaagtatttaagacatcactattgtgaaaaactcatcccaatttcaaagatgcttgtgttaatatgtaatgtgttagttatcacgctaatttgtgatgaaaattgggatgtgttaaatgaagttcactaatttgaaataacatctccataggctgggacaagatcctacaagtctttgtgatctatagaacataaacctggtgtgcattgaggaactgttgaaagctttcctaaaaatggaataaagtatggttggtctccttacagagaatcacattgtattgtatttcttagttgtatctaaaaatatatataatgctgctttatttctttgaagttttattttgctgaaaactatattctcttaaattaatgttaagaagctaaggcacattttatctgcatacatatttggtaggaaaaattaaaaacctgttttttattagttttttacaatgatgtcatcaattcagaaaataaaaaatgctgaggttcccactgaaattgtaccaccgggtgcagtggctcacatctgtaatcccagcactttgggaggcggaggtcgatggatcatgaggtcaagagactgagaccatcctggccaacatggtgaaacctcgtctctactaaaaaaaaaaaaaaaaaaaaaaaaattagctgggcatggtagcgcacccatgtagtcccagctactcaggaggctgaggcaggagaatttcttgaacccaggaggcagatgttgcagggagctgagattgtgccactgcaatccaggctggcagcagagcgagactccacatcaaaaaaagaaagaaaagaaaagaaaaagaaaaaaaaaaaaacaggcgccatggctcacacctgtaatcccagcactttgggaggccgaggtggacaaatcacccgaggttaggagctcaagacccgcttggataacatggtgaaacctcgtttctactaaaaaaaaaaagtatatatatatttttcctctaattgaaatttgcatcaaactagtacgttactttcaaatgtatggatgacttttgatatcaagttcattatgataaacttcatatgttcatatgttaaacttcttaaagaacattgcagttttaagagctgtaagtggatatagatgtttacaaaaatgtgaaaatgctaagcatgtcttcatatgagtctagtagcttgaattttagtttctcatgatttagataaacttaaaatctgctgtttaaaatgtttaaagtgataacaaaaattcagatatttagagaaacatagttaaaaagtgagtaaataatagggtggagataatctttctgtgcaagaggcatcatgtaggatatgtaaattacagaagtctttagtgaaatccactataaagttaaataaagtagaatcaagtcatccaacttcaataatcagcaataaaaacatgaaaagattagactggacagtataaattctgtttctgcagtaatatcaaaggacatatagcaggaaaacagttctttatggagcatacctcaacatattaaagataagtcctaattctctttatattttcataaaactcattattcatatactaaagttctatgaaaagacagtcctttttactaaacagaagatctagctaacactgtatatccttaagggacattaagtggtaatggacattgtatatctttaagggacattaagtggtagatattttgtgcattgtaaaagaccagagatggttgctgctatctatcatctagaaattttatgtaaaccaaggaagtctgagtgatgaattttatggggagacatcattttttccctctccctatcccattccctcccagcttcctagactctatttacattggacaaatttcttctcaaatctaacaatgattagtgagacagaaagcaatggaaataactccactttccacataacctttagaaataatatgctaatggcaaatcttatagatgcattttacaaatattgtcataaattggaatatattattaatgtacttattttactctgagaaagcaaattcgctttccaggttgaatgcaaacatatgaagtcagttattttcattttaaatttatgacttacacttttaaataattttttattgttttaaaaagcataccttcaagtattaataaataaaacattaatatccatgttcatgtatgttctttcttgacctcattaaatagcaaatgaattgatttttatcacttcttcatgttagtaaaatattttgtgagtaattaaagtgagagtcaataaagcagccccgccagtatcagctaagctggactggctgcataatcggaccctggtgcttttcttttgagcgtaaacaattttatggatcaccaaaatcagacaaggtctgtgctcatgaaggaacaaaataaaaataatatcactccacactcatatctgagcacagacaaaaacaataaagctgtctaaaccacaaaatggctaacattcatctttcctatctcttctatagttctttacaaattaaagctttagctttatttgtaataggtaatgttattaccttttagataacaattttcgtaatactcccctttgtaacctcatagagtagaggccaaacttcctggaaccacctccagagtcactaaacccaagcttgaatctcaagcctctgttgaaaccctcttaacaaagtgctcccaaattcttcatggtatggagccaataaactcaagtttgtctaatgacaggtgaatttatggtggtctttaagtggagaatgccaataaagatacttctacttttgactagaaatgagagtacttgtgtctatttttctgtgatcgataaaaaaacacactgcattctcacagatgtgtaatatatgtatgtattggtatgctagggcaaccatatcaaagcaccacaaactgggtggcttaaacaacagacagttagtgtttgaccattctggagtctagaagtccatgatcaaggtcttggcagggttggttccttctgagggctgtaagagagaatgtgttccatgtctctcctctagcttcctgtgtttttctgacaatctttggcatcccgtagttgtagatgcatcaccctgatctctacctttatcttcacatgaaggtctctctcaatatttgtctgtgtctaagttttcccttttgttaaggacaccagttatattggattaagggcccacctactccagtatatcctcattttaatttaacaaattacatctgaactgatcctatttccaaataaggtaatattattacaataaagtgctaagtaattaggacaacaatataattttgggaggacacaactcaatcaaatacaatgtgttttgatgtgaaggaagcataagaggtttttctgtatgttggtttttgttttttggtttgtttgtttgtttagaagtttttttttaaaagaccatgttcttctaattgttctctactaaaactttctcatatttcctctaaggttacctttagtgaagcctatatgcataccctgtgtgcatatgtttgcttgttgtttagtagttctgaattgtattgttgttgttgtttaaatatagctagattgtgctttttgcaatcttagcttaaataatattttaaaaatcataggtacaaaaaaattgaccttactgtatgacatcattttggattctagaaataaaaataaagcttataagattatctcaatgaacacaaaatggggaccagaataagtggcataaatgtagaacgagaaagactgggtgccatattttgtatcaatccgatgatttcaccacttggattttatttttgggtaccatatggtttagattaagataaacccattgataataatttcagtctaataggaaaattatttctttatattaaaatttttgtgaatctaggtaccaccatagaagcacagactaaacattcttattctttttacattttttctcacgtttctaaaaatatttaattgaacattatatctcttaaaccactctcactgccacttccaaaatccttgtcctgttatttttctgtcatatctattttataaaaattcagccattcacacaagacaatgtgtggctaacaatgtggacacaacattccaaagagcttggatccaaacccttgcttgatccttaagtagacacgtgatcttaggcatatgacatttccatgcctctgatttctgatacctaacatagagataataacatcacacaactcataggtttgtagtacaaaataaatgacataaggtatgttaagcatttcaaaaagtacctgccaagcaccatattaatttaagacattaatatcattatctctgtccatttgcctagcttgctgattatttctggtaagacaacaggaattatctcaaaatcaaaatttctaactccaggtaggcacccaactcttagtaattgtattagtccattctcatgaggccaataaagacatccctgagactgggtaatttgtaaaggaaagaggattaattgattcacagttcaacgtggctggggaggcctcaggaaacaattgtggcagaaggggaaacaaacatgtccctcttcacatggcggcagcaagaagtgccgagcaaaatggggaaaagccctttataaaatcatcagatcttatgagaactcagtcactatcatgagaacggcaagagagtaacccacccccatgattcaattacctcacaccaggaccctctcacaacacatggggattatgggaactacaattcaagatgagatttgggtggggagacagccaaaccatgtcattctaccctggcccctcccaaatctcatgtcctcacaatttaaaacacaatcatgcccttacgatagtaccccaacatcttaactcattccagcattaactcaaaagtccaatccaaagtctcatctgagacaaggcaagtcccttctacctatgagcctgtaaaatcaaaagcaagttagttacttcctagatacaatgtgagtataggcattgggtaaatggacccatttcaaaagggagaaattaaccaaaacatagaggccacaggccccatggaagtctgaaatccaatagggcagtcattaaatcttaaagttccaaaatggtctcctttgctccatgtctcacatccagatcacatcccatggctttgggcagctctgtccctgtggttttgcagggtacggctctcgatcctagctgctttcacaggctggcattgggtgtctgctacttttccaggggcacggtgcaagctgtcagtggatttaccattcttgggtctggaggactgtggctctcttctcacagctctactaggcagtgctccagtggggattctgtgtgggggctccaaccccacatttccctactgcactgccctagcagatgttctctgtgagggctccacccatgaagcccacctctgcctggacatccagatgtttccatacatcctctgaaatctaggtggcggtttccaaacctcaattcttgtcttctgagtgcctgcaggaccaacaccacatggaagctgccaaggcttgggacttgcaccctctgaagccacagcctgaactgtacatttcccttttttagctatggctggagcagctgggatgcagggcaccaagtcccaaggctgcacacagcagtggggcccgggacccagtccagcaaaccatttttcccttttagatctccaagcctgtgatgggaggggctgccatgaaggcctctgacatgtcctagagacactttccccattgtcttggtgattaacattctgctcctcattacttttgcaaatttctgctgctggtttgaatttctccccagaaaattggcttttattttccagtgcatcatcaggctgctgcaaattttccaaacttttatgctccgcttccttttggatgctttgctgcttagaaattgcttctgctaaatatcctaaatcatctctctcaagttcaaagttccacagatctcaaggacaggggcaaaataccatcagtctctttgctaaagcataacaagtgtcacctttgctctagttcccaacaagttcctcatctccatatgagaccacctcagcctcaactttattgtccatatcactatcagcattttggtcaaagccaatcaacaaggctctcagaagttccaaactttcccacatcttcctgtctcctgattccttcatgtctctaagaagttccaaatgttcccacatttttctgtctttttctgagccatcaaaactcttccagcctctgcctgttacctagtttcaagctcaattccacattttcgggtatctttagagcagcacctcattacccagtagcagtttactgtactagtacattctcatcatgctaataaagacataattgagactggggtaatttcaaagggaaagaggtttaagtgactcactgttcagcatggctgtgggagcctcaggaaagttacagtcatggcaaaaggagaagcaaacacatccttctttacatagtggcagtaaggagaactgctgagcaaaagaggggaaagccctttataaaatcatcacaccttgtgagaactcactcactcactattacaagaacagcagcatggggtaataatccccatgattcaattacctcccactgggtccctcccacaacatgtgggaattatgaggactacaattcaagatgagatatgggtgggaacacagccaaatcatatcagtaataatttaacatatatttcttcaatttctataatggtgtgttttagctgcctagcgtctatccattagcatccagattttctggtggaggatttcttttttctcctaagtctgtgcttagctgaaagatcatttttaaccttatttatcccactgcctacatagtgctacagaaccccaggtgactagatgcttcctccatttgctctctggcttaccaaaagaggcatattatgccagtttatctaattggataaaaagaaagcttcagaaggcatgcttattgcgatagtaacaataatagctggtgtagcattggtggtgttaggtggattttaagcaggaagaggagtactgatgatgacatcttggctaggctgttatggctatttctattctttctgtagctcttcccaaataagcaaaaactgatcaaatttattgacagtggatcaaccctacaaggaatactaaagggaatcttctggctgaaataaactctcataagacagttacttgaatccataaaaggaaataaagagcattgataaaggtaatacacaggtaaattttaaaagaagtacatatataaaactaaatatattatatattaatatatattattttttaaacataaatacaatatatgtaatacaattttatttttctatttaatttaaaaggcatctacataagtcagtatttataaaacttcattgttaaacttataatgcataaagacatcatttgtatgacatagtacaatggagggagggagagaatatagagatatgttgtatcaaggtttttatatactattgaaattgttaacattaatttgaaagaagtcagtcacaaaagaccacatattgtacaattccatttatattacatgtccagaataggaaaatttataaagaaagaaagttgatcagtaggaagagaggactgttaatgggtatggcttttattttggtggtggtgagatgttcttattagattatgatgatgagggttgcacaagtttgtgaatatcctaaaatccattgaactatttactttcagtaaattttatgaattatatctcaactgaatattgaattttatctcagtaaagctattaacttatagtaagttaatattatctttttaattatattaactgcggtcactgttaaatcttggttagtctcagttaccttatttattgcttgtgtcagaaaaagttcagataccacatgcaataaaaaaaaatccaattgaatttccaaatgattatttttctccaccactggaacagatataatactctaaatataaagagatttttaatttcaaaagctaggcttcaagggagaaaaattgttgaaattgttttcattgtagtgtttgttttgtgtttttgttgttgttgaagtggcgataattgtggatttcctgccgttgacatatgttaatccaaaataagaaaaatgggagaagaaagaggaaaaaattcatagttcccacaatttgcagtaagaaaaaggactagaattttttaatagtctctcttttatagtgagaccttccagttttgaaaccagttgaagcagcacaagtggacacagaaatttcttccatagacagaggagactcgggtttgcttgcagcatgaaatcgcaagagcagtcttacaggaaagtatgcacgtgtagtgcagggcaataataaggtaggaatggcagtagggtagtcaaacagacgttgatgtaacttgccccttcatataccaccacctagtaagctgagagaagatgctgaattcaaattctaggttaaacatcatacatagcagtccaataaattaaatgatttcaagtaaaaaatggtttgtgaggttaaaagtttggaaaacagaacgtactagtcaagatggaaggagtctcctactacatgccatagccctcttctttaaagcaagagcaaacctcagtcttctgggtggtctggttttgtcatcactttttacaaaactaactttaacttgagaaaatagtaattcatgtaaatctgtagcctctgtaaacttctatcattgtgaatacatatagcaatgcaatgaaaatatagctggtgctcatatgtctagggagcttttattcacgaaggaggcccacaagatttaagtagcattcatagcaatgacatgatttaatattcataaaaatggcaaaaccttacaacttaaaacaccccaggtactattttaagtgatttctataaccaagtcattgtatcctcacagaaaaaccttagtaggtattgtagtcattcccattcttccctgaggaagtggagatgcagggcgatgtctgtggggagccaggcttctgtccaggccctgaatctatgaattcaacctcattacagggctgagtgttcttcagaatgcccatgtgcttcagtttttcagaattcatgcgtcacgaatgtggtttacttcttcaaaattgtatttttgtttaacttgaagatattgtaggcattttcatatataaataaattccatttttgctttttattcaatcactaagttgccaaaaagttggaaataataggttttgataaatatgattccattgtttaattcttcagattctttgcaagcaatatattcatgtagctttaaaaaaatcccaaatattatgttctaggaactaacatttgatattgtttgagagtgcttcaaaatgatttttttaaataaccgtgaaaaaggtcagctatacctctaagctttcactgaggactatcatcagtcaaatgattagtttcagcaatttcatggcataaatccacaactagggtgattaagggtagtgaatttaggtacaagcctaaaattgaatcaaatagaagcagataaatacctctaccttattctcatataatgaaactcttcttatgtatgaaaaacatcactatattttgagaaatgctaattcacatttaaatttccaagaaaagtgctcttctgaatattttaaagattattcaatagactttacagagtatatttgtacctatcataaaattaaaaatcaatatgcattacccacaaaagtgtacagttgataaaccatacttagctatagcagattttaagagttctgacttccctcaaatccattacattaaacacttcaaccagctaatgtcaaaactggagcaattgcatatcaccccacttaaaacaatacagcaaaatgcacatatcatgtctactaaaatctctgcaataatgaaaatgaattgattttaaacaaatggattttagtgaatgtataaatctgaatcctttgagatatgctaaatgtttaactctgtttttgtattaaatttaatttgcatttatgcatttagagaatatatgttattcaagcagtaaaaagattgaaaataattattttgttcagtaaataaacagtaaagaaacatggtataagactggtactctggtagagctatgcattcatcccagctgcgcaagaggctgaggcacgagaactgtttgaacccaggagggagaggttgcagtgagctgagattgccccactgccctccagcctgggcaacagagtgagacatcatctcaaaaaaataaataagaggaagaaaaacaaaacaatttcttgcttcctgaatcttgaattttaggtaacagaacagatgtctgtcagtgagagaaatatgtgttttaatgatgttctataaagggtacactgggatacaaaggaggaccattagaaaaaactccccagggcagagaaacttccacacaactttctcaagattaatacagtgagtcactcatacaagagcttattttaaaactcagtccataaatacaaaattcctaataaactgtctgaaagtactctaaattgccatatgtatttttttattcaattctgtgtcagtgtctctcattcttcatcagtcattacttttctatgatcttctagtaattcttcagtccctctcttacagattgaaaaagacttcttcagtcgcttattttatttatgaaatctttacatagcctttctaatatgacatggtttatattaactctatccactgttagtttcataaatgaaacagggttattattaggcaaacataattaattcaggtgctctaaatactgtaggctggaactgcactgtagacattctccagaaaataactaaatgaagattgtttagaatttaacaattagagttgttaattgttgaattctaaactttcttaacagaagcataaaagtaataggaaggaaatgcattccaggccaaagggactcatgaaaaaaagaccaggggtatgaccagaaataaaacaaacatgtaggaaggcatttatgcacagatgaatgggctacaaataagggaggggatgttatatgggcctgcgttgccttcctgtgtcagaaggtgcattaggagagcacagtccaaagtccacctagcattttggaaaatactgtcaagaaacaagtaaagattcagatattggccgggcatggtggctctctcctgtaatcccagcactttgggaggccgagacaggcagatcacaaggtcaggagatcgagactgtcctggctaacacagtgaaaccctgtctctactaaaaatacaaaaaattagctgggcgtggtggcgggcgcctgtaatcccagttacctgggaggctgaggcaggaggattgcttgaatccgggaggcagaggttgcagtgagccaagatcgtgccattgcactccagcctgggcgacagagtgagactccgtctcaaaaaaaaaaaaaagattcagatatctctgactctaaacagtcaaaaagtcaccacatgatttgttctacccttttcctcttcctcttgcctatttgtaatgtgtgttttttttttttgacagtgagaagcttggctaccatttataatttatttacttacttgctgaactctacttttacatgtaaagtagtttcagagttgtgcatctatacctcagtaagaaacaaatttaccccaaagagtatgatgtttttgtacagttattttagcttttaccttaatgtcgtcaatcaaaactcttgtttctaaagttatttagatcagttccttttctttccacatcatttagtgatgtcttaacttttctaatgtcatacttttctaatgaactagttctaataaacttttctaataaatctgacttcattagaagtttttgtgacagtcttcattagcagatttgtgacagtctgctttctgttattggaccctcctacatcctggttgatgtttttaatttgtgtacaataagttattacttagggtagagctctattgattttgacaaacatgtgtaccatcacaggactggattaaacaattacagcattctaaacattctcttcaatgcctcattaaaaacaatcccaatctcaactttctgtcaaccactgatctgctgtctgtcctgatatttagctctacattttcctgaatgctgtataagtggaatcatgcaataggtaccttttgtgtatggcttctttcacgtaagaaaatgcacttaagacttatcagtattgtattaatcactttgttcctttttagtgccagatagtatatcattgtatttatgtaccagaagttatctgttcatctgttgtaaggcatgttgtttgtttgcatttattggtgaatacgtataaaggtgaatatgaatatgtataaatgtaccctataaacatttgcatatataacaaaatctttatttcacttgagtaaatacttgattgctggattgtatggtaaagtgaatacttaattaacactaaattattatgccggatttcttttcaaagtctgctttactatcctgcattcccatcatcaatgactacactttgagttcttctgcatcacaagcatttactattgtcatttgttttgtgtttatttcatttttatcttactaagaggtgtgcagtgctcatcatggagtattaagatcaatttctgttaactttttatttttatatagcttaaagcttacaaacaaattaaaatagtgcaagaaactccaatgctttactcagagtcccaaaatgttttgggatattttgctataattgccttaatattttatctctatgttcacttatctatattatatgcatttctacaataatatatattatctatatcatatataattctttttgtgaaacattttagaggaagtttgaaatattatgaacctttatccttaattactgcagtatgtgttttctaagaacaatgttatttcttacatcatcatagtacaattacaaaaaccaatactattgactatagttaataataatgtatacataaaatttgctgagagtagatttttagtatagttttcacataatagtctagtaattttgaaaagtgcccttcaattttggtttatctgatgttaccttttgattcaaattcaggttttatataactttgaaagaagtacaacagaagtgatatgttatcctcagtgcatatcagtggacatttttagttaggttgttctaatatttgttaacttattccagtaaaaaatttatgtaatttatccccttggacttaatgaataattttgttatttaagaactataaacatgtatttttgttaaagaatctttcacccactagtttagcaatcattgataattttccaactccaccttactttcatgtatatgttgattttctgctataaggaagagctttgcctttatacctccctaagtatttgtctatttttcaatttattatacatttatataagaattgaatcatcagttattatattattcagtgaattataatacattaactttattatttattttactgctgaaatttcctcctacttagccagtggaaaacctgtagagctgtcccctgtgtccttttgatttattctcctttttctttgagtacttctttataatgcaaaaaagatatttaaggtttctcttttaacttccttgctctaggcttgaaatttatcttttctgtaaaaagtatggttcctttaagtagagaatgatattaagaaatcaagatctaggtgatcagagtgttctcttataaagggaaagagttaggaaatatgtgcatgtgtgggtatgtatgcatacatacatacacatatgtatatatttatgtctatatattgatatacatacatttatatgcagatacgtactttgtaggaattatataaatacacatgcacacatatacactcatatcagatttatactgataaaccattgacccttgaacagcataggtttaaatgacatgggtctatttatatgcaaagtttttcaataaaatttacatggagtgtgcctgcctctcctgcctccccttctaattccttgacctcttctgcctctgccacccccaagacagcaagaccaacctctcctcttcctcctcctccgaggtctattcaatttgaagatgatgaggatgaagaactttacaagaggagaaggagccaagatggcctactaaatgcagataggaagagcatctcccagcaagagaccagactattaagaagactggcacactgtgtgaggatctttggaagaaaggaattcagagcggatggaaagaagatggatacccggggctgaatggggagcaatctggaatctcttcattggcctgctgagtatgagggacgcattcctggtgccagtgggtcctggggaaggggtgagacaaataagcgaggatggcccactctcactatggaacaccagaatgctagcttcaggacacctcatggccaccatggacatttgagctgacaagaagagctgtttagagaggtcagacctccagcctgtgtggattccagagggtttggctcaagaacagctggagaacagctagggatgtacatcccccaagtctggccacattccccgaagtgtctgtagcctttgatgactgtcagacctggacaaagcagggtgatcttgccaataagatggatgtgacctgagctttcccttctctgccagccactcctagggtccctgcttggctgatgctgcttgcagcacagtgtcagatgcccaaccaggtgcttcctggtggccattgccataggtcctttgttgacagaccctccctaaccatcagagagcttctgcagacagactactgccagcatgcacccaactacgcacagcatccccacactgcagcctccccacaccactatgctggcacacattcacctgtagcacccccactgatttgctggcacctgtgtaggcagaactcactgcatcccctgagcaccctgtccacatgcatgtactccactgtaccactattgctgctggcatgcatgcacaagctgagatcccactgccactgctccagtgaagcatgttggctgacagattccatcggggtattgttgccagtggacagggcataccttgattcctccaacacagcaggtgcttaacgttgagagggtcagagaaaaaggccatggacctgttagtagcccttcaggggctgctttatagtgtcaatcaagtctgcgtaacaacaaacaacaaaatgacaggatcaaatccacatatcaatgttaaccttgaatgtaaataggtaaatgtcttagttaaaaggcaaagaatggcaaggtggataaagaaataagacccaactgtatgctgtctttaagagacccatattccatgcaatgacacccatagcctcaaactaaagagatggagaaaattctacaaggcaaatggaaaacaaaaaagagcagaggttgctattctaatttcagacaaaacagattttaaaccagcaaagataaaagaagggcattacacatgataaataggtcaattcaacaagaagacataaccattctaaacacacacacatttatacatattatatataatattttatattttatatatatatatatacacacacacgcacatacacacacacacacacatatacacacacccaacactggagcacccaggttcataaaacaagttcttagagatctatgaagagactttataaccacacaaaaatagtggcagactttaacacctcacttaaagtattagagaggtcatgaaagaagaaaactaataaggatgtttgggacctgaactctacacttggacaaattgacctagcacacatgtacagaacactccactcaacagcaacagaatatatattcttctcattggcatatgacaccaactctaaaattgaccatgtgataagacataaaataattgttagtaaattcaaaaaaacaaaatcataccaaccatgctcttggaccacagtgcaataaaaataaaaattaataccagaaagatctctcaaaaccatacaattacatggaaattaaacaacctactcctgagtgattttttgagtaaacaatgaaagtaaggcaaaaatcaagaaattttttgaaactaatgaaaacaaagatataatttaccagaatctctgggacattgtgaaagttgtgttaaaagcaaagtttatagcactaaaggctcacatcaaagagttaggaagatatcagattatcaaattaccatcacactcagagggaccagaaaaaaagaacaaacaaacctgaaagttagcagaaaaaaaaataagcaaaatcagagctgaactgaaattaatacatgaaaaatcatacaaaagataaacaaaacccaaaattggtttcttgaaaaaatatataagattcataatacactaattagacaaattaaaatgttgaagatccaaataaacacaatcagaaatgacaaaagggacataaccactgaccccacagataaaaacaaaaacaaacaaacaaacaaaaacaaccctaagaaactattatggacaactctatgcacacaaactagaaaatctaaaataagtgaataaattcctggatacatacaacctcccaagattaaaccaggaagaaactgattccttgaacagagtaataataatgagatctgaaattgaatcagaaaagcctaccaaccagaaaaagcccatgaccagatgtattcagaggtgaatactaccagacatatataaaagagttgtgatatagtttagatatttgttctgtcccaaatctcatattgaatgaaatcctccatgctggagggggcctggtaggaggtgttttgatcatgggggcaggtccctcattgcttatgctatctctgtgatgatgaatgagtttgtatgtgatctggtcatttaaaagtgtgtgacacctgacctaccactgtctctttctcttgctcctgcttttaccatgtgacatgcctattcctctttcaaattctaccataattgttagcttcttgaggcctcccaagaatctgggcagatgccagcaccatacttcctgtaaagcctgcagaacggtgagctaatgaaatatctctctctttttttttttaaataaattacccagtcttgggttctttttatagcagtgaaaaatggtctaacagaacattggtactgaagagtagaatattgctataaaaatacttgcagatgtggaagcagctttggaactgtgcaatgggcagaagctgaaagagtttggagggctcagaagaagatgggaagataagggaaagtttagaatttcttagagattggttaaataattgtgaccaaaatgctgctaatgacatggacagtgaagcccaggttgctgaggtctcagatggaaatgacgaacttattgagaactgaagcaaaggtcacatgtgttatgccctagcaaagagcttgactgcattctgttcatgccctagggatctgtggaggtatgaaatcaagagtgataatttagaatacctggcagaggaaatttctaagcagccaagtgttcaagatgtggccttgctgcttctaacaacctagctcagatgtgggagaaagaaatgacccaaagttggaagttatatatgaaagagaagcaaacataagagtttggaaaatttgcagcctggtcatatggaagagaaagaaaaagctttatcagaagaggaattcaagtagcctgtggagtaatcactttctagagatgtttgcataacaaaaaggagccaagtgccaatagccagagcaatggaaaacatgcctcgaaggtatttcagagaccttcatggcagtcactcccatcacaggccaggaggcctaggaggacagaatcgtttcataggccggtcacaaggcccttttgaagttgctccccatgttctggcctctctagcttcatctgtggctcaaagggacccaggtacagctccaggctgccattctggagaatgcaagtcaaaaaccttggtggaatccatatggtgttaagcctgtaggggcacagaatacaagagtgaagaatgcttggcagcctcctcctggatttcagaggatatatgagaaagcctgggtgctcaggtagaagcctgttgcaggggcagaaccctcacagagaatcactactagggcagtgctgagggaaaaagtggggttggagccttcacacagagtcccaaattgggcattgcctagtggagctgtgagaaaaaggtcactcttcttttgaccccagaaaggtagatccactgacagcttgcaccctgtgcctggaaaagctgcaagaattcaattccaatctgtgagagcagccctggtgctgaatactgccaagacaaagctgtggagctactcaaggccttgaaaacacaccgtttgggttccctgccctagatgcaggatatggaggcaaaggagattattttgaagctttaagacttaatgtaattacttccctgctgggttttgaacttgcacggggcctgtagcccctttcttttggctaatttctcccctttggaacagcaatgtttacccaatgcctatacccccattgtatcttggaagtaaataactaggttttttcaaaaaattcattttacaggatcacatgtagaagggacttcccttgtctcaggcaaaactttgtactttgagttaatgaaatgaattaaatctttgtgggattactgggaaggatgattgtattttttgatgtgagaagtacatgagatttgcgaggggccagtggtagaatgatatagcatggatatttgtctccacttgaatttcatgttgaatggcaatccctattgctggaaatggggcctggtgggaggtgtttggatcatgggagcagatccctcatggcttgttttgtctttactatagtaagtgagttcttgtgaaatctggtcatttaaaagtgtgtggcacctccccctgactctccatattgtttgctcctgcttttgccatgtgatatccctgctccaccttcaagttcttccataattgtaagatttctgaggcctccttagaagctgagcaggtgccagccccatgctttctactaatcatgcataattgtgagctagttaaacttttcttctttataaattacccagtctcagatatttatttatagcaatataaaaatagcctaacactagctactacaattcctactgaaactattccaaaaaatttgaggagaaaggacccctttctaactcattctatgaggccagcattattcctttaccgatacctcacaaagaaacaacaaaaaaagaaaaatttagaccgatatctctgaataacatagattcaaaaatactcaaaaaagtattaccaaacccaatttagtaccacatcaaagagctaatccaccacagtcaagtaggccatattcctgggatgcatggtttgttcaacatatgccaatcaatacatggaattcatcacataaacaacactataaacaaaacccacatgatcatctcaatagatacagaaaaggctttcaataacactcatcgtcacttcatgttaaaaaccctcaacacactaggcaatgaaggaatatacttcaaaatactaagatccatctatgacaaacacacatcatactgaacaggctggaagcattctccttgggaaccagaacaagacaaggatacctacactaactactcatattgaacatagcaccggaagtcctagtcagagcaatcagtcaagagaaggacataaaaggcatccaaataggaagagaggaagtcaccatgatatgattgtatatacagaaaattccatagtctctacccaaaagctcctagatctgataaacaacttcagtaaagtttcaggatacaaaatcaatgtacaaaaatcactagtatttttatacaccaatgatgtccaaactgagaaccacattaagaatgcaattgggttcacaatagccatacacaaaaaaaactagaaatacagctaaacagggttgttaaaaatttctacaatgagaatttcaaaacactgctcaaagatatcagaaatgacacacacaaatggaaaaatgttccatgctcatgaattggaagaatcgttgttaaaatggccatactgaccaaagcaatttacagattccaatgctctgtcaaactagcgatgacatttttcacagaattgctttggctatccaggctcttttctggttccatataaactactaataatttgtattattaataatttgtttgtaatatatattatatatttttatattatagtgttatatattatatattacatagtaatatataataatttattaataagtactttattaataaactattaataatttatatggaaccaaaaagagcctggatagccaaagcaatccttagcacaaagaataaagccagaggcatcacagtatcagaatttgaaccatacaacaaggctacattaaccaaaacagcaggcactggtacaataacaaacacatagaccaatggcatagaatacagcatccagaaatagagcggcacacctaaaaccatctgattttcaacaaagtcaagaaaaagaagaaatgaagaaaggactccctattcaataaacggtgctgagataactagctagctatacgcagaagactgaaacttgaccccttacctttcaccatatacaaaaatcaactaaagatgtattaaacccataaatgtatcacctaaaactataacaatcctagaaaaaaaactaggaaataccattctgaaaataggccatgggaaagaaaatattttcattatgatgccaaaagcaattgtacaaaaccaaaaactgacaaatggcacttaattaaagaggaaactttcaaccagataaacagataccctaaaaaacgggagtaaatacttgcaaactatgcatctaacaaatatctaatatccagaatctgtaaggaacttaaacaaattagtaagccaaaaaaaaaacaaaaaaacaccattgaaaaatgggcaaaggacatgaacatttgtcagaaggtgacatacacatgactaaatctataaaaaaaagttcatcactattcattagataaatgcaaatcaaaaccacattgagataccatctcatacccactcagaatggctatccttaaaagtaaaaaaataacagatgtcggtgaggttgtggggaaaagggaatatttatacactgctggtgggaatataagttagtcctgccgtggttaaaagcagtttggagacttctcaaagaacttaaaacagaattatcatttgacccagcaatgccagtactgggtatatacccaaaggaatataaattgttctaccataaatatgcatgcacatgtatgttcattgcagcactattcctaatagcaaagtcatggaatctatctaaatgcctatcaatggtggagtgaataaagaaaatgtggtacaaatacaccatggaatattaagctgacataaaattgaatgagatcatattctttgtagcaatatggaaggagctggaggccattatcttaattgaattaatgcaagaacaggaaaccaactactgcacattcttacttctaagtgggagctaagcgttgagtacacacagatgcaaataagagaacattgataagaggacctacttgaaggtcaagggtgggaggagggcaaggatcaaaaaactacctatcaggtactaagcttattgcctcagtgatgaaataatctatctgtacaccaaacctccatgacacacaattttcgcacgttatatacctgcacatgtaccttctgaacttaaaataaaaactggaaagaaaaaagacctatatgataactttcacttaataaaaagtaaatgtattttctcttccgtatgattttcttagtgttttttcttttctctaggttactttattcattgtaacaatacgatatttatacctataacatacaaaatacacatatgtgttaatcaactgttaatgttatgggtaaggctcccagtcaagagtttgttattagttgttaagatttaaggagtcgaatttatacataaattttcaactgtgtagttttagcacccttagttcccacattgttcaagagtcaactctatacaatcttatccaatcatccaaagtgttaggaatattctagtatcatatgtaaatacatgcatgtacatatatttatatttatgtttctatgcctgtgtattaaaaaacatgagtttatactcatatctccaatttataaacaatacctcagggtgccttttacttctcctttccgtattagcagttcctcctccaacagtgagaaacctagcttcattaatttcaacaatatctacaaatttgctcaagtcaagaatgcatggcaaaaaggtttagaatcactaaccaaaaccactaataattaataattaaacaaatctaataagaaaacaatttatcatcctgttcttagctaaaatgtacacataagtgcataatcctaaacgtatgtagattagatgggttttaaaaatgcatacagttttaaaactcacattttttaaagatataatacattttcataaacagaaaattccttctgtccccttcccaatcaacactgttacttggggtaacaatttttttaatgtttttccttatttttgaaataaaaagtgaaatcttataataggtcccttttcttttatcttttgtttagcataatatttgagagagtcttatgtcagtagtttgatccttccttcactgagtaatagtccattgtacatacatatcactaggtccttatttattttcatgttgacagatatttttttgtttccaaatctgggttacaatcaataaaactgctataaacatgcttgtaaatgactttttatagaacaatattttcatttcacttgtttatataaattgttattcttagcataggtgtatgtttaattttaaatataatctgcaaaatgtttttcaaattttttaaactttcatttgattccctatcaacaattttatctttttaccaacagtgtgtgagactttgagttacttcacattttcaataatttttttattaactttagtctctggaggagtattcacttttggttagttttacatttttctgatgattaatcataagaattttttacttatctttcaatgaaaatattttctccagttatttgcacaccgttttagtgttttgttttatattagtgaattataagcgctgtctggatatattctgctttatgtcctgggtatgtgtttgtaagtattttctctcatgcttattcattttctaaatagtatcattggtgagcaaaaattttaaatttggttagtctaaattatcattttttctttaatgattattgcttattttacatgttctaatacaaaaattcctactccttgataacaaagaacttctacattttctccttcatagttttaggttttacatagagaatgatgatcatctaaaattagtgtctttgtgtatgatgtgaggtagaagtcaatgtcattttttccgtatgaatatctaccatttccaccatcattttttaaaaggcttttattttcttattgaattgctttggatattttgttgaaaataaattaattgtataagtgtggttctatttctgaaatttttcactttcattgatcaaaccgtctttttatttttcaaattaaacactttcttaagctgtaaaatcagatggtacaatttgtcaactttttcttgtatttaatagacttattggccattatatgtttatacatttctatatcttaaaacacatgtcaatttttaaaaaaaactacttgcattagaagagggattacattgaatctatgaattatcttaaccacatttattcttccagtatgtgatgtgattacatttttccattcttatatatttaatttctcttcgcaatgttttgtatttttctgcatattttcctttttaaaaatattaaccataaatattttatggttttgcagattttataaaaagatattttagaaagtttaatttataatctcaacctaagtcttatgctatgatggaggaagacttttggtatcttagtaaaaaagggtgtattttgcatgtaagtggaatataaataatcattgctagatagcaaaatgtagtaaaaagtaaatggataaatagacaaacaagaaaataaataaataaaataaatattacctcatttttgaatctggatggactctgaaatgtttgcacgatagaatcttgcagaagtgttactttgccaattttggcccacggatcttaagagacttgcactttctgattctttcctcttaaaatagttgctccttaccaggttctcaacttcaccattaatgacacttttatcagataatttttagttgtatgagacttcgttactcattgtaagatgtatacagaatccctgacctctaccttgtatttgtgaggctacgccaaaaaatgggttgtgaaaacaacaaaaatttattgtttcacagttctaaaagctagacatccaagactaaggtcttggtaaagttgattccttctgacaactatgagagagaatctcttccatgttcctcccatgttttccagtgctttgttgataatgtctgtcattcgatggcttgtagaagcatcaccccaatcactgctttcatcttcatatggaggtctccctgtgtgtctgtgcctaaattttcctttttgataaggacatcagtcatattagattagaaacctatcctactcaagtatgacttctccttaactaattacatatatttgagatgactttatttacaaataacattacattgtgatatgacctcactgagggttagaactttaaaatgtgaatttttggaggaaaaatttagcacatagtatactcacttgatgcctcttttattcctccagtcctgacaaccataaatgtctctaggctttgccaaatgtctcctggaaaggcaaagtcatttctagcttagaaccaatgttctaaaaaaatttgattacccccaggttgccatgttgtaaggaagcccaagctagtcatacagaaaactacatggacagaagagtgtttgaccaatcccagctgatcaagtgggatgataagtggtcatttttagatattatgtaacacagctcaatctctggccacaataactaagatgctcaataaggaaattaaactcttttctacctataaatatcttatcacactggaattcacttaaaatctagaatagcattatttagattaagtctggatgtagattgcagaattgtagatgaggctactttactacagtttctctgttttcacttttgggtacagtttttcttgattcagagacttacaaatttaagacgagttatctgctcatccatattctcaatatgaaaagttaagcagagacagaaatactacaacagataaacattcttaaaaaaggagagaagaagaaaggtatatagcacagatcagtccatagtacttctgtgacccttcctctgcaagccataagtcgtggctcacgttgcaggtgaataattttcttagccagcttcctgccagacacacaaatctctcagaattatgttctctctaccatgaggtaagagttaagatatgtcctcatgatttaaaaatatatttatctacctgaggggtctacattcctctgccttagatgattcttaacaaagggtttaaaaaccatgcacccttgatcttgacctgaaccctacttttactggtaatgtcctggattcaataatggctctgagtctattttgaaaactttttaccagctggaagtctgaaaataagaatcttatttattttccaacacagtactcctgtgttaaaaatattttttctaaattttggttaaaaacagtcccatcgtcaactcatctcttatttcctgttttatcataggccagtaaatgaagctatttggtaacttccacattttgtcctgaaatcttagcctagttaataaggtcatgctgtatattttctatctttcacattggcacaagcaacagtgatcccagtatttggtcaatatataatacagtttccatttctccagctccagtacaaatttcctcactgatcttacagacatcattaaaattttctgtttttgcaacctctttccaaaatagtctcaatggcacaaaactgttttatttatggtagcatctcacttctaggtactaatttctgtttcaattgtctctatctgtaacaaacaactgacttagagacttaacaaataaaaacctattattatttctcatgaatctgcatattgtatgcatggttctgctgctccacattttgttgactggagttactgatcaactgaccccttcagtattatgataatcatttttacttctggtctgggatctatttgttctaatatgaatatagatcatcacatttttatgcctttttttgaacagtatatctgtctttcttgcaacttatctatgtctttatatttacctgcatttcttgtagattgaataaagctgggccttgatttttttatccagatgaataatctatacctcggttggatttttgtctagttcattgacattttatggaattattttgatcattgaatttatgtttaccatttgctttttgtaatttggcctattgttttttgttgtaattttcttgctttcatttctgttttattttggttaaatatttttattatttcattgatatagccatccctttttaaatttttttttacttgttgctctttggaatgccttttgcataatccatttaaatttgcactactacacatataagaattttacaccagtatggttcaatttatcacatttgctatattattgtcatatttgttatgtttattatttataaatccaccattcagcattataacatttgtcttaaacagttgcatgtgttttaaaaaataaaaattttgtatattctagtgtatgtgcctacatatttttcattttcaaagacttcatgtctttctgtaagtttccacttggtgctatttccctttatgctgaagaaattctttaagattttattagcttaatatttattttattaaaattattatatatatgtttacgagatactttaaaactacacatttggctaacattttaatttatttctgttgggaagcactggcctcggttatgtctatgtaaacgtgaatgtgtattaaatttcctgagggtcatgtgaaaattcaatttctgattctataggaccgggatggcctgaaaatctagatatcttttgattttattctacattttaaaattactgtgattttttgttaaatcataactgtatacatcatggggtacaatgtgatgttttgatatacgtatacaaagttcaatgattaaattgagctaattaatatatctattacttcatttatcattttttatggggagaaatttgaaagttactcttattttgaaatatacacatgtagtaagtgtttaaagcaaattttataagggtgaattgtgatgcttataaataacataactaagtgtaataaatatgacaatagtacagcaaatgaagtaaatgggactatactggtatattatttttatatcagtgtgtcatagtacaaatgaactctaaatggagtatgttaatggtaatctaaagtactttattattcactgtagttacactgctatgtaatagatttcaaatcttatgcctctttttgaagctttgtacccttttatcaacaattcctaattccctcctgcgcccctcctccagtctctggtaagcattattttgctctctgctactatgagtttaacgtttttagatttcatatgtaagtgagattatttggtacttttctttcagtgtctggattattttatttaacataatgttctccctataggttaatcaatgttgtcacaaaagttctttttcaataatatttcatttatgcatatatatatatgacattttatttatccattcttccattgacagacacttaggttgattccatctcctgactattgtgaataatgctgcaatgatgtgggcatgcaaatatcccttcaacatacagatttcacatcctttgcatacatacccagaaatggaattatttgatcatatgctagttatattttttagttttttgaggaatctccgtaccatttttcatgatggttttactaatttacattctcagaatgtgtaagttccctttttcctgcatcctcaacaaaacttattatttttcaccttttgataataataagagccatgctaagaggagtaaagtgatatttcgttgtggtttttataatatttgtatttccctcatgcttagtgatactgagcatttttaaatgtatctgtttgccatttttatgtctgcttttgagaaacgtctgttcagatcctttgcctatttttcaaccaggttgtgtgttttttgttatagagttgtttttgttccttatatattttggatattaattccttatcatatgtacggtttgaaaataatgttttcctttctgtgggttgtcctcattttgtttgctttgccatgcagaagctttttaccttgatttcatcccatttgtctaattttgcctttgttgcctgtgcttttggagtcatatacaaaatatccttgcccaatccaattttgtggagattttcccctatattttcttctagtaattttactatagtgaaaatattctgaggatgaagtctctctagtaataattatattcttgacatcgtgctgatatgttgcattgtctctggattctgttttcttcctttaagcaatgatgttatttattacagaatgatgttatcacatctgaactcaaatgccataccccacctcaatgtatttggaagcagccacaaccactcagctcctcatactttcagtggttgcttccactggggaaaattgagattccctatgtgtgtgtcattcaggcattaacaaaggatttgtgcaatttgtattttggtacccttccttatgtggtgtcctttcttgaattccccagccccttcacttttctgccattctgggagcctcaaattgtcctgtgactcttctacacttaaaattgcagctttctcctattgttttcactgcccatacatatcagactgaaggtagccctcaggtgaaaagcaatagaaatacacattttactcagcagagcttctttctttcaaagcttgactcctctttaatttctgtctgcttctggtaactctttagtgccttaaaacagttgttttcatgatctgtttagagttcacaattgtcatctgaagaatggtttgtctatatgctattccaccattgccagaagcctccaggattactgtttgcctttttgtgtgtgtgctctcctaagtccacaatatcttagatttctgaacactctgatctttgacaaaatacaattttcatagtgcaatgttttctaaatcatttatttccatttaactctgtgcttctcacttgaatcaacctcccactgtgatagttttccaaaaccttgccattgtatcctgctatagtctgaatgcttgtaacactccacagccccgaatttttatgttgaaatctgatttccaatgtgaaagttttggagatggagtctttgggggcatgatgacattctgagagggaaaacctctcgaataatttctgaggtgtataagaaattcgagtccttataaaagagactacagtccttatagaagagatccttcatcccttctgccatgtcaggttacagtgagaagataaccacatatgaggaagtgagctggtaccagacaccaaaactgtttgtgccttgatgcttgactttgcagcctccagaaccatgacaaatatgtttgttgtttataagccacttagtctatggaatttaagatatggactctgaaatatttgctaagaggtttaattgtcctagagggtttggctcaagaacagctgtagaatggctagggatgtagctggtagatgtagatgtgtttagaatttaacaattagggttaaacagctagggatgtagttggtagatttgttatagcactgcaaacaaactcacccttttgttattaacaacctttcttatattatttattgaatatacttttaccttattgcttcattaaaacctgtttcattattattgcatcatattccttttgtccctcttaagcaacagtttttttctatatcaataaaacttcagactcaagaggtgggattacattcccctggttattcattgacacaaagaacctattaatttctctttatttcctcaattctggactactccaactttttaattctatgcaactcctcttaggctacagagcaccaatagagaaaaatcacacaagtttgaagactgatgtcaagaaatgtgtgaactggacttcaatagtgcctaaatttttataatggaagactcttccagggaaaagagacagaacctcagtagaatcaacattggtacagtgataaatttattagctcaagtagcaaatcatgagagtagaagtgcattcggctcaggtacattagggactataactttgccatatctgtttgtctttttatagctttccttattattattatgattctatccttctatgaacttttttcttccaacttgaggacttccttttgccagtaattgtaaattcatgtttcatatggtcaatgtcaaataaagtctgagcaacattttcccaaattcttcattcaagattccaagaataatttttgatgtggttgagggtagatattaactctagtcaaactagcaactcctaaagaaaaatgtggttaggaaaatcattttcaagtgaaatagacactatcaccagcatacaggaaaatgtatattcatttaaatgtgaaaagttttatactctctgatatggtttggctatgtgttcccacccaaaactcttgttgaattctcaaagttggggaggaacctggtggaaggtgtttgtattatgggggcagatgccccataaatggctttcgtcacccctttgtgataagtgagctctcattttgagttcatgggagatctggtcatttaaaagtgtatggcaccttcgcccctgccccactctctctatcctcttgccatgcaatgtgaagttgtgcttgcttccccttcaccttctgctgtgattctaagttttctgaggcctctgcagccatccctcctgtacagcctgcggaactatgagtcaattaaacctctttttttttttttataaactacccagtctcaggtaattctttatagcattttgagaatagattaatatactttccttgaattataaattgttatttttctagtcagtcacagaatataaccatacctccaaattccagagaacatggatttcatcaaataactccctcaaatttctaccagtaaaacctctagtcttacctatatctccatccatactttgtatttggttactttattaccaaagaacgacagattcatcactgttgatcttgacaaagtccaatttattaatttttccatttctggatcctgttttttgtttcaaatctaagaattctttgaatagctctaagtcccaaatattttctcttatgttttattctaaaagatttatgattatatgtttcacatttaaatctatgaccatttatatttaagatgacatttaatgttatcaccagatttgtagattaccatcataccacattccactgccctctctgttaattatcttctctacctcctgaagttgtagtttctacttctggtctaacatcttcctatgcacacattaggattactaagtgtgattggatcctagcaggcaagagatgatgcaattgaactcagaaatgtgtggggaatttaataagggactacttacaaagtgcggcagagcatgtgaaaaccaccagaaatagaatgaggtcttttctgccacccaggagctgagtggaggtagctgagtggatggtgctagaacctaaggcagaggagctgtgtggagaccactgccttagggaagataacctgatcagtggaggggcatagccagcttgaggcaaaacacagagggaaatgaggtgataaatgtatttgcatctgtctcttcctttcctcttatttcatattggggctcccatttgccaaactcaaaagaaagcatggaaaatacaggtcatgtagtgtagcttcttggacactgagtagatctgaaagggttaatggaagatagccatagtctcttaagccccataacattttgataaacaaatcttgcttttgtctcacgttccccctatttagcctcgtttctccttaccacttttctaccaaatattttcaagaaggaatctagttttactattgccactttttcatttcatctgtacagtcccaaatatatcatcatcaatgactaaactccactgaaaactcttcttgtgaaggttaccaaggccactttagtaatagttctctggaccattttcacaccaaatcacattggactgtccaatcctatttaggactttcttactacttcttcctaattggaactctcccatcttttgtgttcatctttggcttctcattgtgtgttcctttcccgatccagcctttatattttagtatttcttagtaaccaatcctatgaaaaaacttgaccattccatatatacttctttttgactggtgatttataaaacgatagtccttctagaactttctcctatgcttcagatgcacatactaggattatttaaaggaaaccttgattttaataatttacaatctgacagattcagtatgcttgaagctctcctgatctccctcttcattaaatgtgcttcttccactcctgtttccctaaagcaacaatccatttatccgacctaggaaactgaacatcattttctttttttcttactttacacatctgaacaccacaacattctaacctattttgtctgtaacctaaatatctcctgaaattatccaattacctaactcaagccctgtttccatacctctacaatagaccacagcttgatttctgcaagcagttaattttttctttccagtgtgccataagtagattttaggtgccttgtcacaaaaagaaaagtaaccacatgagatgatagatgtgttaatctgcttcgctatagtaaccattttactatctatatgtatcccataaatcatgttgtaaatctcaaatacacaaaagaaaattaattcaaaagaagaaaaaaatcaaattctactttataatttagaataatctccccaaatttatgtttaattttccccagattaatgacttcgcattgcccctaatattccttgggtgacagttctggtttgaattctgttgaaaactccagcttcatgttctcagagtaattttagctaaactgaatgtctttgaggtctttgaattcccacaggttcttttgcctctgctccctattttatttaaatttattccaggaacatgtataatacgaggatatgcatggcagtttagcacttatcaatatatacttctttcaatttaaagggaaaagaccatttttcacatgctgggaaataggtagttgacacatttgaatagatttgaacaacctgaaaagcatatatagtgaaaaagtttaaaagttgaggacagaatgctgaataatatcacagtttaagggtgagtattgtgctggaaatgaagaaaggtacccatttagaaaacaatagcgttgttattactttccaatttttcaaagctttcagaccattatgaattcaatgcaaacaacccttctctgtgatttttaacttaattataattttgtctcattgttagagtgtcaggagtacattttctccttttgacaatgcaaataaaaatgattagtataaaacgtacggtatagttaaacatttctctaagtttaccagacctgtcatcctattgttgcacataataggtaactcagctgggatgggccgtacattaacttgttgataaaaccatataatatgtttatacttatggtcaattacagtactttttcacttgatatgctaactttacagaaaatatagtcaaatataattacccacccaaatggagcagtcaataggttataaaggaagaaggaataataggtctggtccattaacatgaaataaaattaaaatagtagaattaaatacatgtttggccaagatattaaagagctttgaatctaaaataaaaataagagaaaggaataaaagaagcaaaaaaatattttgttttaaatggtagatagaaatattcacatctttcactcaggttccctatatgcttgctgccaaaataaccttagcatgttagcacttacaacgaactaaaggtaaggatttaatcaccaggaagaagaacacaatactgctaataaaaaccaatatttgctccatatttactgtttaattgctagacagaacaaatgaaagacaaaattaacttcaactatttaacgaatcgtttattttttttctattggattaataacttattatggactcagtattttacagttcattcaatttatttgaccactcctccaaaataatactcatattgtcattttcattaaagaaatttaactgacttttggttaatattctaaattgatctggacttgactttaatacatttccagaacattagagatggttgtttgggtagcccagccaaaatattttatactccaagaatctttagtatagctgtagattgagtagactggagcatttaattacagcatctgtagatccccattgtagcttgacacaagaatgactgaatatggcctgtgaaggctgaaaaactaattgctccattatctgcactccagtctttttcacttcacaagcacttaaaaatatatacttaaatctgctttctaattacaagttcccataacagagtgtccctatccagaaaacagcattattactctggctttcaacacacttaagcatttttattttgctgagttttgttcttctttgtttactttcttttgtaaacatgtttaatggctaattaccatttcagctttttatattaattactacacatttagagacatgtgtctttaaatctctagcagataagacatttgctttgctcaaacattattttcattttacttgtctatacgtagctttagcagaatgacattcttattaagtacttactttcttgagaatcaagcaataatttatgacaaagccttatcttttttgcattagctactgaaaacttttatattttagaacaaaagagtaacaacttatttctcagcatcaatatatgacagaaatataaggacaattgttttaacagtgatatatgcaacattattttcccccagaactccttcatttaatgaaattcaatatgtgcaggtttcattttatgaattataaagtcatcaacaatttagtttgatgccagtaaattcacatttaaaaatctgaattgtgcatcatactttatttttaaattgacaaattaaaaatgtatatatgtagcattcaatgtgatgttttgatacatgtatacattatggaatggctaaatcaagttaatgaacacatgtattacctcacacacattttgaggtggtgagaacacaaaatctaatctgtaagtaatttttaagtatataatacattgttttaaactatagtcatcatgttgtacagggcatcttgaattaaataaattctcctaactgaaattttgtatccttttaccaatacctcctcttggatgaacctggaggacatcatgttaagccaggcacaaagagacaaataccgcatgatcccacttatgtgtggaatctaaaaaaagataaagtcatagaatcagagagttgaatcatacctttctgtaggtactagcattaacttcatatagattacagtatcactgatatattaataggcaatattaatattaataggcaatttgagtattgtggtcttttctacccactaagaaagcagccctattcctgaaatgcactttgcttctttaaatacttcattggtaagtaagacacttcctcaattttgtcaggaacaacatttacatggtaggcagttatcttctctttacttccattatatttcatggacattagttttagaatttaaaactgctgattgggtaagggttgccttattggttagcactgattataatatattttaaggaaatagttataactatgtgaaaaaatagcatttttcacatacccaaccccatttagttctgggggaaagatgagtaagtgtgcttaatcccaggtgtgtgtgtttttatgtgtgtgtgcatttatgtatgtgcttaataattacttttcttatgtagaaagaaaatttatactttgaggcagtatttaatctcatttactttacactcaaaacataaaatcccctacttaatacattttgtatatcaagacaaatttatacaaaattcatttttggaagtgctgggcatagagggcttttaataaagagtgcctcagaaagccatcattggccatgacaatagacacgttaatgacaacagtgcttattaggaatgacttcctcatatctttttgttttaattaaaatagaaaattgtggtatccgaacatggaaaatatgtatgcagtctggatcctgctttgctacatgaaaagcatgaggttttgttcaggtatattataataattatatcagggaaagtgaaaactcatttttacatattaaaatttttgttcatttctgaagaaaaattaagtccacagtaacagaaaaccaaataataccctttccttcaaaaagaaatacgtatttgaaatttatttgctaagttcagtttctaagactagaatttgaaagggagccagattaaatcaaagccaaccacttacgccagtggatgaacacttcatggaaaaagaattgtattaagggatttattttccacatttatttgttttttaaaaaatgaagaaaaaagattctacagatatcaaaaaatatacagcattaataacattttgtatgaaagctatgctatttttggaggatctgtaattttagtactagaaactaacatgcataaaaacactgcattattcagctctgcagaagtaattacaccaagatttttctaattattttctattgttcccataaatggactatataatcacaattcccttttcggacaaatacctttttccagtatgtgctttaaaaagttataactggtaataaaacgtaacttctataaatggcaaaatgtttgaactagggtaaattctcagaaaaacactcaaattctcagaaaaacactcaaggtgccatatcttacaatttcatgtatttgctaaacagtcactgtacatattctttacattttcaaacaaattcataaatgcataaactcataaagttatgtattattattatgctacacattttactcaaaatgaaacagttatgaatctaacctagtacaatggggtaagagtcatctacttcttatataaaaaagatagacatcattttatcaaaatatatgttcatgcaaataagcatctaatagacaaaacttggactatatcaacagaaagccacaattagctcaaaaaataggttataggttatagtttgatcattttctacaccaggggccagcaaatgttttctatagaggaccagatagtaaataatttaggatttgcaagcaaagagaacatatactctgtacttgcgtctgaagcagccatccaccatacataaatgaatgagtatagtcgtgtttttgagaggcacaaaacaggtaaaggcctggatattctcccacaggacatattttgctaacctgtatctattgaattccaaacaagtaaagttatcaaattagtgaatcaactaaaaatttaccaacttaatcttgtgattttaatgtgtcattctggagttacattgtttatgtgtactatttttctttctttgggaaaaagactgtgaaatcactaacaggctcagagcgaatttaatcagaaaacaaagagtttctaagttttacaaatagaaattatttgagctttttgcatagaaactgaactcatagatggattatatatacactttttcaaaaattgtatttattcataacaataaaaaattcaattctagtgaggtattcaaggaaagtctttcctattagcattcaaaggttaattcttaacaatgctggttgctgtaaagaacaaagtaccttaaccttagtggtgtagcacaataacaactcataaattaatttgtttatctctcagtataataggggtattcctggtctgtgaacatcttttcatataagaattagggacctatactcttccatcttctggcttttctctagtttttcaggcaactccaagaagaatgtagaagaaatgaaaaagttaaaaactgtgagatatttttatgaaccacattgcaagataaaaactactattgattttctgttggtcagaattcattcacgtggtctcatctacatacaagataattaagcctgtgcctagtagcaaaagaaaaagataaacatgtagccatcttctgatataccagacatgtttccagctgaaagatgtataagaatataaactgaattagaatgtatttatgtctaggatagggtgtctacagtataaatttatgtgatgtgatttccagaaaaatattatacattattaggtatgtgcattttaaaataatttaaccttgtttttgcttttttgttttatgtatgtacagttccattgaacgtgttaatgtaccatataaagctaaggcactaccattaactgaagaatccttttcactataattcatagattaaaatatttagtatttagtatatgaaggttaaaatatttatgattacctaacatttctattcatgctttgcaaattctgttttgttttaatggaaaatattttggtttggttttggttttaggttttcttttgttactgttttttatttgtttattgtataaatggggtctcactttgtcactcaggctgggctgcagtggcacaataataattcacagaagcctcaaccttatggggtcaaccaatcctcctgcttcagcctcctgagtagctaggaccacaagcatgccaccacaactggctcatttttcctttctatttcttagagacagggatttgctatgttggccacgctggtctagaacttctggcttcaagcaatccttttgcctcaacctctcaatgtgcaggggctacaggtgtgagccactatgtccagcctaatgtaaaatattttgaatcagaaattatttgcaattgtttatttgtaaattaaacttttattttagagtagttttagatttacagaacagttgcaaggatagtacagagaggtcctgtatactccataacaagtttcccctgtattaatatcctatgctactatggtacatttgtcacaacaaatgaaccaatattgatgttattaactaatgtctgtactttatttgtatttccttagttttaagctgatgtctttttttctgttccaatatctcttccaagataccatattacttttagaagtaatatttccttaggcttctcttggctttgaaagtttctcagacttttcttgcttttgatgaccttaacagatttgagaaattctagtcaagtattttttagaatgtctgtcaattgggatttgtctgataattttttgatgactagactcagaaaatgtacttttgaaaggaagatgagagacaaaaagtgccattctcatcatttcatatcaaaagtttaggttattaacacggctgtgtatgttgatgttaaccttggtcctgtagctcaggtagcaattgtcagacttctccactgtaaagctgctcttccctccatgaccccctttttacatgccatactctttgaaagccagtcactatctgctgtccaaatttaagggatggggagttttgttccacttcattaagttcaaagtacctacataaattatttgggattattgtacaaaaagatgcatctattacttctcatttattcattcaaccatacatttccattagtatggactcttacatatttatattttgggtaccagccaatattcctttattttggtgctcaaatcattctagctttgatcattgggagctccttccattggctcgctttgacttaatctcagacttttgtgtttaagtacttccacattttctggcattacaatattattcatgctatatttcatgctttagtcctaaaatagctagatctctaaggagatttgattttttaaattgaagaatgtatgaaaatccaaaatctgggcagtagaaaaacagctattttttaaatgaagtctaccagcctgggcaacacagtgaaaccctgtctctacaaaaatacaaaaactaccctgatatgctggcatgcacctgtagtcctatctactcaggggactaaggggaggatcacttaagcccaggaggcagaggctgcagtgagctacgatagcaccactgcaccccaaccttgttgacagagtgagatcctctctcaaaaaataaaaaatgaagtctaatatttttaccgagattacttaggccattccctctgtatctttaaagatgtatgattaaataagtatgaattgatatcccacctgcccaagcatgataaaatagtgtctattatataaatattacatatttgttagaacattgttggaaattataattaaacaattattattaatttttggcagacattgtggtatttaaataacatttctcatttaaattacattcaactaaatgagctagatatattcttattgtcatttaacagtgagaaagttataacttaatgtgtttaaatggatgtaaaaatatttgaagtgaggcaaacaatcttacatttttcataagtaattataagatacctttttaaggtaaataggtataacattaaaaaaaatctaaattaattttatttagttgaacagtttcaaatttcttagcttagaaagagatactaaagttcaaggaagtactcaatgaattagtatctatatactagttgcaataatatattaacatatttataaggcaaagcaaggatttgtttagtttatggagaaaaaatacaattcctgaactgaagttgaagaaataccatcaaagttgaacactgaaaaattaaacagatgattagcttagaaagaagaagagaaaacttgacaatttcataagaaattaaataatacagaagaatatttcaaatataacatgctaggctggtaatatattccttccttacttttttattgtatcttttggtttcattggtgacctttcaaatagaaaaataagaaactcaactattttagtgtgtatgtaaacaaaactaatttcactctagtttctgcctaaggaataattggttggtcactttagaagctgactttaagaaaatgaaggactaataatgttgttggaagactgaaatgagttcagacaagagacagaagtgctttttaaagttaattatgtttgcttttccttatcccttggtgttcattacctttaaatggaggcacacactggcagaagtaattaccaggttggtcaatgcaggtggctccatttttgcagggatgtgaagcacactcatctatatcaatttcacattgcgtacctttggaaaataggaaaaaaaaatgttaagtgttaacaagacaggcatgtatcaagtcgtaattcttaaatttgcacaagcctttaatccacttaggatgacatctgaaaccaaatttattagataagaatgccacatatattactatcagaacccatttatttcaccttgctacaaactgtagtaacttctcttagaattactaaaaggacactaatctcttctgagtttgtaggcatgcaaagtctctttagatgtgaactaatttatcttttgctagagagtctagagatggtgcagatatttcaggttactgaaatgcagatcaaatgttaggtgaaaggaaataaaaaaggaacgaaaagaaaatattggtgaatcaataacatcctgatgtatgtccctgagggctgaatgttatttgttcatttgtttgttttggagagggaatctcgctccgtctcccaggctgtagtgcagtggtgcgatcttggatcactgcaacctctgcctcccgggttcaagaaattatccagtctcagcctcctgagtagctggaattacaggcacacaccaccatgccaggctaatctttgtattttcagtagagacagggcttcaccatattggtcaggctgttctcgaaatcctgacttcaggagatccacccactttggcctcccaaagcgcaggaattacagacatgggccactgagcctggccctaaatgttctttataaggcacagttattgagtactatttactaataaagccatgagtaatgggtagatgcatttcaatctactcatgatctttgtagatataatattatggtgccagggtgatgaattactttttttctagtaattttacaacgtaagcctatatggaaagaaaacaaataaatgtccattaactatatagtcttagcattttctttaaactgttgtccaattcatattttcattcatcctccacctagaacttgttttgctaaagctgacctttcttattataccacttagattgcttaatttcccaacagttgaaaatcatagcctcaactgacactgaattgatttttatcacttatgacagctaattttcttaccaatttataacaataatagaaaattgacattgacacaatgcaaattattagcaaattatttgaatggaaacattccttctttttttaaaaaaattctgtaaaacagtaacatgaatttagaaagaagaaaacctacatcaaattaatctaataggaatcaacgtactggactaaatagaaaatatcactattatcactgacaaaatgaaatatttagtgaatacctgacactagaacatcagggtaagctgagaaaaaaagtgaatattaaaaagaattatgtgagtgaatgaaaactttttaaaccttaaatatattagtttttttaatgagataatttaattttgtggaaattgagaaccctactgtcaaagcaaaagtttaaccagaaaaaaagttaaacaatcaggaaagattttattgaaggctattgcaatcaaggagagaagccaaaaatcagtctgagtttgactccattgtaacaatggttgagagtttttaagagctggggtaagagagctcataggtcatatgcatttgctatttagccttaacaaaaagaaaattagatttgtttttcaatcttcaagttaggaggtagtattacaacttggatcaaggtgcataccaaagttagtctcctaccctcctacagagactgggagattacatatgctatcttccttacacttcaaagggatggctcccaggtccttgagaaagatagtcttgggttcctaaatgaacaagaggcttttaaagatatttataccccaaagaggcaaagaaagaatttataattattgggttctgaagtaaattctctaagaaaatgaaggggaggaacttctgtggttagatcatttagatcctgtaaagaggtaacaagagaagcacctcaggaagaaacctgtttaagtttagtcacactgagggaaacctgtttgtcttgtgacaaatacactttgtggagattcctacagtcctcaagttcccaaagactggaaggaggaaagaaataatgaaatattaatttataatattaacatgatactcttctaaatttctggtgaagttggagaaacatgggtcacattcctgcacacaggggaatcaatcaccctgtccctctctaggttactattcttaaatatgtctctgtgtcttctgatcccagcttccccttatcaacctgaatgtcacactgccatgagcttgtatttctaaaagacaaatgtgatgaaatagctaacaatttcagccttcaatttctttccacccctcatccgtatttcccaaactaatctattagagcaatcctaactaatgaggataaagaatttatgatcttagacatcaggagggtttgacaagacacctacaaggaagactttttttttttttcaaatttgacactttaaattcatgcaaatcttggattttgcatcatattttatcctcattaatatataacacattctataacacaatacgtatacacccatagggaaacttgacagtccaagatgattctacaatcactgttgtgactttcatgaagctttaaattcatcccctaaagtacagtgctttagcaggagaaatacaaatttagaggatgatgtaaaaaactcacagcatactttacaggaacatcatggtctgtacctagccttccttcttggtcttctctctcttatccttccctgtttcttgttcaccctcttacccaagtaaccacaatgaatttttaaatgcctgtgattttgcctgggaatacctggtttccttttaaaacctggatcatctcaggtatcctctgcctattctttctgggtacaggttagcacaacacttttctagtgtttacaccttcttctgcagtcagttgcatatataaatacatatatatatatgtgtatatacatgtgtatatatatgtgtatatatatatatatatatacacacacatacatatatatgtaatttctttaaaatgtatgcttatgaaaatattttctagtatccatggctcttagaatagctactgtctgatattagtgctcaaaaaccatttgttaaatgaatgaaaaattaacagactaaatgcagaaaaatgccaatgatactgtatctgtaaaggacaggtaatcattttcaatcctgtttaggacaaatcattaacaaaataataaaattccaaatgatgtaataaatatcataaagattgccagaaacagattttgcgactgactcttcaatttcagagtgtgttccacatgatttggcaacaataggccacatttaaggtgtacatgtatataattttagagcttttattgccaaaatgtagattgaatttaaatgagatttcaatttgattcagtgagctgtagtaaaatttccacttatttgacaaataaattaataagcataagtagtttgaacacattcaataaaatagcattcatgtatccttttcaaaagtttctgggcagacaaattaaacaatcaagcattctacatctcattattttaaaatagactttaatttttaaatagttttaggttcacagcaatattaagcagagggtacaaagatttcccatatactcactccacacatgcgtaatctctcccattatcgacatcccccaccagactggagacatttgtgacaactgatgaacgtacattgactatcagacacttcattttaaaataagtttcatgtgttaatttctaaataatcatattttttcttcctcatgtatttctaggtctatgtttcaattccacctaacacacacacatacacacacacacatatacatttaaattagttttccttttaattgtttaactgaattttaatctgttacttaatgatatttacttccatcatattcctcaattgcttgcaccatctgggctaaatcacactgtgatcgttttctcctcataggaaccatcatgtaggaatcatccattgaccaaaaagcaatccaaataattagagttctgtttcatgcatagtatctcaaacattctatgctttctttactctgggttttctgtttcttcttactctttatttttttgtggtctgtcctaaatcctgaatttgcttcctgttttctcctgtccattggatgtcacctttatttttgtttattcattctttcatttgaaattatatttttctacctattcatgtaattgaaaccatcaactgatttacagaaacctcaaccgtatcatgccctctacatgacagactcccaaatcaaaatttctccagtcccaggaactcctggcttcaatgcctaattaaatattagttgacaacaccacttggacatattctaggcatctcaaattcaacatgggcaaacaaaactctctaagcagctctaccttccttattaactgtgataaataacaaaacccaagagttattctttattgttcctcaccctccctgaattattagtaaatctttgcaactttatgtctaaaaatgtaccaaacctgtctatttatctccatctctattaccaatatctagtctaagtatccccatccccaatgagaacaagagttgctttaactgtttttctgctttcactcttactctaatgcagtgcacaacacatccagagtaatttttttaagtgtaatataattaggaaatacaaatccagtaagaaagttaatggcagtactccaaactccttaccttatatgataaggccctgaaaacctttgagtttagaacacatagtaatcctttcttgctcacttattttccagccacactgaacttctttagattattttaccaaacccatttttacctgagggtcttgctctaacaacttctatcactggaaagtcttctctggaggataactcattcttatccagtttttggtgtaaatggaaaccgcataaagaggattatctttactatccagtaactcctctcacatcaccgtcttttactttgctttataaaacttattacacacatagacatgcatgtatatgggtatgagtttgtgtatttcttatttttgtttggttttcctcccacttgaaaattagcacacaatagcaagtaccttcttttccatccttagctgttggaaaatagttgacaaaatagttcacagcgcaaagttgggccacattaaatattttaaatgaattcatgtattcttggaagtcagagtccattattagtatatgaaaattacatagaaatgcaactgtttatataaaacaaagaaaaaatagaattataagaacttaatttacatattttacaattttctgaaattatatgtaaatgtctttcaatcttcaatatttatgaatatcattattaaatctggttattattaatgtagaggtggaagctattgcttatcctactgaacttgtttgatcaccatcaaattcctttttacatatattttggtttgtggaatgtattataaactacatttattctaaacaaaagtcttactttaacataaaaatctcactgtatagcacgttatatgagatttcttcttcagtagaaaagaaaaaggcactaagtactattactgtgggagaactagagcatagagtatggtcagaaaaatgggggtaaatgtcccataatttcaaatcaagtcagagcagtagctctttcacttacaacccaggtcagaataatggccaaaaggtgtctgatccaaggagtttgggagaaagtcaatactttcaccaatgatgtaattaaatgaggtagaaatctaaagttaaaggaaatgtcttttctcttccatgcttagttttcattcagagtaactttgccttaaaactcttgaccttctgttattcaaatttttttcttcccaaaaatggcacaaagagttatctaaatggtgacaaatagccattggctcaaagttgttagtttacagtacagctaaactttcaaagttggcagaagagtaaatcactgtctcttgccttcctcactggtactgatagaagccaatagtctaagtactctgctctgcagactggacatactcatttggattttacactaagctatatcctcctagactttattattaatgtaatactttgttggatggaagaattttacactaagctatacactaatactttacactaggctatatactaatgctctgccatatactaatactgctatacagtaacatactttgctacatactaatatactatatatagtatattatatattgcatattataagtatatagtatatataacatatataatatatataatatatagtatatatagtatactatatatcatatactatatattatatatgtatgatatatatatgatatatatgatatatatatcatatatagtatactatatatcatatagtatactattcttctctttatttttttgtggattgtcctaagtcctgaatttgctatatatcatatagtatatgatatatataccatatactatgtgatatatagtatacgatatatcatatatactatataccatataccatatatcatatatactatatactgtatatgatatgatatatagtatatgatatatagtatatataatatataatatagtataatatatgtactatatactaatatactctgctatatactaatatactctgctatatactatatatatactataaaagttatatactatatagctatatagtaatagctatatactaataccagtactttgttggatggaagaatatgatttatattatggttcaaactcaggcagagaaaaagaatgctatttcttggttcaaacactcacagacccaataggtctaagtgtggtctgtgtttctgtaataccagaagtggacttgccctctattccctcctcaggtagaatctagaaacgttatagatctctggagataaattggaaaaattgtatatgcaaaccttggactgaaagctgggaagtgagtacctaagatcttagttaaaggagctgaatagtcaggatggccctggaaggtgagtctcacagaaaggctgatccttaattttaatgttcacctctagagctcactgcaaacacagacactaggcatggaagtggcaggctgacttgagatctgattctttgtgtgagtaagccaccaggaaacccctaggcctctttctttgtgactaagaatctaggcgtgctgagccttcaggtgtctaataacatgatggagaacatgagtttatagagcaggtgtcaattaataggcatgtattaaaatttggggtgacataataaaatcatcacaggacctgtcttataaattgaaaattttctcacaactgtgatacagtttgttgactagaaatacttacttcccagatgataatctgctaatggctttaggccaactaaatttttttcagtgttgaaaaacaaatcaaaggatttacttaaaagtgatttgtctgggaaaaaaacaattttttttttttttttgagatggagtatcgctctgtctcccaggctggagtgcagtggcgcgatctctgctcattgcaagctccacctcccgggttcacgccattctcctgcctcagcctccagggtagctgggactacaggtgcccaccaccacgcctggctatttttttttttaatttctagtagagacggggtttcacagcattagccaggatggtctcaattcctgacctgtgatctgcccgcctcggcctcccaaagtgctgggattacaggcgtgagccaccacacctggccagaaagcaacatcttttaaatgggaatacacaagatcagatttatagtaattcttcttcacactattgccacacatgcctaggaaacttttataactggcagttggccttgtaaattaatacgtttgacagtgcacagaagaatgtgtcacatgtatttgttttcaatccccacacttactaccttatggttttcctatggtccttgctattagaacctatccaataaatgtaaatttcattggctgtctacattatttacagatatctacaactgaatggccctcctgcaaaataagcatattgactgccttcagtttttgttcaaacatcttggtttaattagttcaatgacaaccacaaaaataaagaggctagggacatcattgcttgttgatgggcatggcattttcaaagccacagcatctgagcctggccaagccttttcattctggatcccacagagattcctcatatcagtaaatggttaataaaataatctcaatttattaaacattaccacttgccactgtccaaacatgtatattgttactagaattgataagatgaagccagtgaaattacataaatttcttaaagctgtgagtcatgtaaaaattatctttgattgtacctttagcaattttgaacctatttccaggtcatgtacaattggtaataacaagattactcttggcaattatacacttgcagatttcctaatattctcaggtgaaataacaatatggaaacccattttcctataatgctcagtctcataaatgaatacttttttgtataatgaagcaggagcttattaggcatgtcatcagagttgaaagaaaaagtacaacagacctgtttcatgatacagtagactttatatcacagagtgcttcagaaagaagatattagatttatagaaataatcttgtctcagtttttagtcaaaattacaacatattcaaaagactgaatacaaattgattcaaacttgaattcattagggaagctatctaaattggttagattttatgctttcaaatgagttcctttcttagtagacatttgctaatcatgcactaatctcactgcagtgaaagtaattaattcacaaatagttacatattgcattgtgaagatactaatgatatactgtgcatgcaataattgggaaatgggctataaaatatctgcttaacaatatcaaatgggactggtcatttaaatgtgatatgtaacatttagcatatagaattattattcctgaaacgacagaggagagaaaggtcatggtcttttactaattctacttctaatcagcttaggaaaatggccttgttaggaggaaaatggcaatatactttcaagaattaagatatctgctattcttaataatctgtgtctgttggatcaaactaaagaaaagaagagaactagagagtgagaaaaagttaattatatccccaaagggacaaagagacatgtatgtggagaattcaattggaaatttccatttccaaactaactcaaagtcctgcagcaggtcatttttaaaatcaggcttaaaatacatatgtctacacccaagaacaggatattctttctgaatagctggacataattaaatgattattcttccttagtccctaaaaattggagtctaacacaaacagtaaaggataaaaaaaaataatgaaatctaagatgccacagattgctcaattcatcacaaaattgacaaacacaccattaattattggctctctggttttagatatgatgtgaagaaatacaataagtgtgctttagaatgtataaaatattgtcaaagccagaaatcaatgggtgtatcagttgggggtccagagaggagacaggaattacattagtaatttgaacaggaaaaattcttatacgtaattattaactagaaaacataattaactactaggaggagtaaagagacacctaaaaaatagaagattttgggctttcctaatatttgcaagtaatgtctcccattgcataaagttgtccactcatggacaggataacgcaaaagtaccatggcagtgagaagaccctcctaccaaactcaccatgtttttaaaaaatattttgtttcctgtttttaataattttaatatcttctgttatttacatgttatataatgagcatagagtcaactaataatttaattacagtttcagtaagggatatgcttattaaagaggcagatattaattctatcacatgctagcaggttaatagtgtgaaggtagggttaatatcctcaggtcacactgctacttcctggacattaattcctattcatataaaaatcactgtattgcaaagtctaatgacaatttttgacgttatcttctatgccctcattgcatttctccttctcttagaaactcttcctcttatactaaagattttattgcctgagagatttttcaaacctatttctgtcatcttggctaatgccaacatgcatttagagcatccatgaaatcagtgcatttctcattttctcaacattctactttccaacggagtcgaatgttaaggaaatccatttcacatcagtcacaccctcccatggctaatccaaggatattgccctcactgttctctcaaataatgaatacaaacattctgctgacatattattattcagttaatcaagtgtgacctccatcacctatccttgttgcccattctcaatttctcccattacacttttactttgaccttcaggcctttgtactattttttcttctattccatgaggccactcttgtgcaaatattttcactcctttgaatttttttagtgatatcaggaaagcagagagtagtcatagcttctcacctgtgtgtctatgtaccaacatgtgagttccaggtgggactagatattaatccccttagccctagcccaggacatagaaactggccaataccagtttctaggtatcataggccagctacctctggcttcaagaaggcttgtaagtatgtaacagatgtcagaaaatgttaccaatttttacttgtgctctgatgttaaaaaaaattgttggcaagcaattctttgaattaatgcaataattgtttgcttatgttcaactctactcataagccatgctctgcagtatctgttaaattctcatgctatttataaacctttcttagataccttagtatacttttaaatttctctgcactcctctaatatctaatcttgctaaaatacatcatcctttcaagagatgatttaaatttttacctcacagagacaatagaaggcagaagagaagcactccatcaaatttaggactcgtaatcttcatgtttacacacattttctcctacatttttggtactctctttttctttccgaaaataaatgtgatattactcctacacatgtggttgttactcaagcttgaagttttgggggattcagtatctccttcctcatctcttgcatcttcaaacttctgcttttactgtcttctttgatcggcatttaaaactattctagccttttctaccttaaaagaaaacagaaaactttcatcttacatcatcctcattctttctctcttccttcctttgatgccaacttcctttaaagatttaacttatactcattttctccatttccttaagtcaactcaatttcagtcacagaacaagtgacttctgcctttccctctacagaaattgctttttgccattgttacaggacatcattaaaggtaaatccaaactgcgatcttttggtccccatcttacataatctcgagatgacattgtttattgttgatgtctcttaagtgcactcctctcagctacacttctcactgttttttatcctttactttgtgtgtctctcgatgtagcttctgtggtttttctactcgtatcttaattattgacatgcctcagctttggtcatgggctctctttctcctctcaatttgtatacatacctgagtaaactcatacattatactggttttaatttttattttttagatgattgactccaagtttacatccttagctcagatttttcttctgtgcttcaaaatctctccttcaactgaaatatctgaacagctattgaaaggttaatttgggaagcccataaaatagtcagatttatattttccaatataaatcattatctttctcccaaacctttgatttctaatcctgtttttcagtaaataacaccaagtctatatagatgctcctgtcagaaaactgatgtttcttttcagaacctcactttcactaattaaactcaagtgatacacacgtcctgtaattttatctccatttacttcagtaaaaatatgaggttaaaacaattcctaaatactgtataataaatccactcttccttcaccactgcaactatctaatcctgattgtcattaaatctcccttccattacaaaaacagcgttctaagtggctttcctgctttgggtcttatctacgtgctaattcattcttcatccagcagcaaaacttctctctcttgaaacacaaatatgaacatgacatttggcagtgtaaaaccctcacatatgtctcaaatcctcttaaggtaaaagcccaaatatctcagcaagttttacaaggttctggagagtcttcacccttgttaggcctctaccttatgtcttgtcactttctttgcatccacacttagcagtcactcacatgcactcactgttggactctactcataacaaccttctctcaatctcctacaatatttttctcattcttacatctagagttttgtaattttaatttttttttgtttgtgggtacactgtaggttatatcatggctagggattttaatgctgttttcttggtgataaagaggtcactagcatcctggccaattcctgttactaactatatcccattctagatgagacttattttgagaaatcttctttttctatgggggcaaatctggattaggtccccctcctttgtgtcttcaatacttcctgttatgtatttgcatcgcatgataccactcatgtctatgtttaagtttactggtctgtatctcccactcaactgtaaacagaacagttttccctactattgaccatttaatactctatgcccggcactattcataatccaataaatatttactaaaagcatagtataataataaactcaggataaaatggatgataatattaaattgcattttacattatttagaaatcacctatacatacatttgtcacttttttatttcacagtttacggttaatatgacatttactatcttaaagacctctcttccttaagaaatggtcattcttttatcattgctggacatgttgttttagtttttaattataaatttgtctttactaaagccaaacaaaaggaatgtatttaaaatggattatggctaaatggatgaagtagttatcactaacttaaaaaattgcagaaaaatgtagaatttagaaaaaaaacaaaaacttattttaaaaatacaaataatttaaatccactctagagagcaagaaagttgttagtatataaactacccattagggtttttaactttcagcctatttgatatcagaaaatttgtttggaatatgcacttaaagtaaaaatacattggcatatatctaaacaatcagaatgggactattccatattataaatggaattctggaaaaaataatggtagtgttgaaatagtttttagatttctgtgaatgcccatctaataacaggcagatcaactagataataaaatttaaaacccatgaatggcatgcacaacaaaatttagtgacatggtatccccatgaatacatactcacatataccaacaacagcaactctaaaattattcacaagaaccaagaacaatgtgtcacatacatctgttcaactgacaaccaagggaaataatatggcatcgtatgggcctgaagacaagataattcttaaatagatgtgaagtattccctagaaagcatagtaaatcaacttgagaacagcagcatgattgaatgtgtcctctccaaaattcatgtattgtaaacttaatccccagtgcaacagtgttcggaagtgtaacattttgagagatgtttaggttatgaggtcttcactctactacatagattaatgccattataaaagtgcttgatgaggaattgcatccctttttgctctttcatcttctgaacctactagtgtcttgatattgactttccagcctccagactataagataataaatttctcttctttataaattacccagtcttaagtattctgttacagtacaaaatggactaagacaaatagtaagctccgaaggattttgtctgcttgtacaatgtgggattaaaacagataaacaaaaatatcttcagaacagtgcatccctataaactcacaatattgagctgcctcagttgtcttcccaaacagggctacatattggggagaaattgtaagaaatttaatagaaattgagtaggacagggaaaatagacattaaagacagagaagactagacaatagtaggagaaggaatcagagacctaagatatcttagcatgcaagcagatatacaccagaacaataaacaaacaaacaaacaaaaacaagagaagagacagattgctgtgaattgaagaaagctaccctgaattatgtctctttctaaacatccataaagactaatagtttgtgaaaataagcaaaagaaattatcaaaatcaactccaatacaaaattatttaaaagaaatggaacaatattcttaaagtgaatgaaagtttctaaaataataaaagcaaataatgaaaacattgtcaaagtgagatccaatctgcaatgtattactatttcaaaatgagctaaaacattttgagaaaataacctaagctatgaagatacaaaataccaattagaatactcagtaatgaggtcatcaaattcaaaaaagaatcacaaagtgaaaactttcagaaatgaatattataccaaaaagaacatgacaaaggatacatacaataattacgtaagataattatttgaaaaaaatcaagtaaaaaggaaattaagaaagagataaaaatgatttgagagaaataggcaaatattgaaactatgcaaagaagattcaatatttgaattaaaagactccctggaaaagaagcaaaagaaagaaaatgaacaaacattatataattaatgttttttatgaacaaacattatacgacattatataattaaacattattataattaaagaaaactttcctgaaaaagaaaaaggtttcaaactacatggaaagattaaagaaaatatagacaacactcagatatattctaataaaataactgcatttcaatgaaaaactaataccctttgggcatgtagcagataaaaaacagcaattgatttacaatgaaaagaaaattagattaacatcagacttttcaacagcaacatattatgccagaaaaaatgatatatttaaatacttaagaatatttaaactgtgagaaaaatagaaaatgtgagtcaaagattttacagagtaaaactgactttcaagtataaagatcacagacctatgatcatgaacacccaagaatgcaagaattatttccattagccctctctgaagtatatcctagataaataagctttaaacaaccaaaataagcagcagagatcaatatgagaataggtagtgtgcactgtacatctatctacttacagaacccaaactagataaaggaaagtgtattgtatataatgcctacaggctcagaatatagatatataataaaaattagaggaaaatgagggcaatatatgaacaaaatttaaaatgttacattgattatatttttatatatactttttaatattttttatatatgaaaaatgagatattctgattttgttgtcccttattttattgagactagacttttattatggaagaaaggatatacaaatattatgcagaagatgttaagtgtaagattatataatgctgaatttgaatttggtagctctggaatgaagtaatgaatacattgatctgtgccatatacttgaaagtatattttaaaaatgcgcacaactaaacactgccacctagaaatgaacacttgaattataaaagcaagaaagtgattctctgaaaatgaggagattggttagttttgcagaaagggaggtggtacgttgccactgggcacatggaagatgtttaggggtgaagttcgacttcttcccctaggtggtagttataagagtgcattaccttgttcatcttataataacttattaagatagtatttattttgtgtggttttatgtattttcacagtaaaatatgaaaataaaacggaattgttttctaactctagaaataaacaaaaatgaaaaacaggtaattccctttgagactacaatatgccgactctatggtaaatactggtcctgaactctgtaattattcctttcttcagctccacaggttcagccaacatagaaatctcggggtcatagcaggtacagcactgttttctcacctgcactgcatctcccaaattattgtcctgaatgaattccgtgcagccctgcccttcatggcataatcttgcctgtttctactcaaggtctcggtgagaccttgtagagaccatgtggcaaaacattattaaatatgaacgtctctgagtggctactgccgagggagtgcttaataattttacaaaagcaatattgttaaatccattttcaagttacgtttcatctaggaacttacacttcccttctagaagcagagtgtatgatattattccctctatagcagtgagaaagtgagtgcgaaatagcagcaaagcagtaatatcaatgtcaaacacagagcatcagatcatagcagagaaatgaacagccaagaggaggctgctttgtggggccaagtaacattttgaagaaagttttaaatgagaagtatctaggaacataattgactgctgagacaggtaaagacaggcctctgtttaaagagagaaatatgaccaactaaactgacatgtgcttcaccaaagatgatgggtgggacctcactgcatgcaaaaacagaagaaacgttcacataagattactccaaaaactagggcacattgtctaagagtttcggtaatttttaacagagaaacaaatgaaatggtattaaaagtcacatgatgtaatacaagtagtcattgtgtataatactgaaaatcactacttaataaaatgtatataattttcatatcatgttgtgagttctcacccactctacttgttatcttcagtatatttgtaggaggatttttaagttgagaacatgagttcttagtcactatcttgaacatttttgaagctcttagactgtgtttgtatcccaccaagagtttgggtacatttcttgaaaaccaagggtgtaataatctaaccacttctacaattcaatgagtttatcatttcacaaaacactgcctacatgcatttacacatattaatggttttaatattgccaacagcttaacacaaaatttcttcacattttgaaagtattaaatattttctaaaggatggaactactatataaacataaattcatttaacttatatataactaacttttaaacaattcataacaatatagttgctaatttatgtgtttttctatatagttttagaattactaaaagctttttaaaggaagagccagaaacgttaataatctgaggaagttcgggttaaagttttagatgaacccaaaatgttatacaattccatgttacagtgaatttcttaaatagtattgtatcagtcttttagttcagaaagctcttatgattccacctacacagaatactagttcctgcatctatggtaaatattcatataaatgcatagtaaggtaatatttgagtttctcacagcctaatatttctaaggagaattatagcaactcttggagaattgttaacatgtcaattctaacctctagtgagttgaaaagtttcatttgaaatgaaaattcatttgataggtctaaaatgcataaatatctgattatttcctggcaggcaactacagtaaaatctcacacctcaatttttccagatcttggaagtacattcatcaatgtctactgcagtttttatctgacagagaagaaaagcaagcattaaaacagtaaatcaagttggatttgaaaaaaacaggaagttactttacagtccaaatgacaactacataatttaatgataagaggtttgtaaaaccacattttatttttgctggacagttttaaaggtaaagatgatagatcatacatgctacttatacaaattaagttctccaaagaaaaaatgtctaaaaatttgaaataaattcagaaatacattgtatcactcttttattgtggcattttaagaatcttgtttttaggggacttaaaactaggaaaaaatattgaggtcatccaagtttgtattatatttctgttatcttttgaaatatcaaattataaaatatatcatacatattgacaatgacatggcaaaataatcagagacaaaattacatatgtccattaaattggtaaataatgttacaaacctttatagggtatgaggcatcccattgtttgatatatattctctcttggtactttaaaacaagtttgtgaatagctatcatcatcacagttttagaaatggaaatcctgggatatagagctaaacttatttgttcaggtttacacatctagaaagcaacaaaattatgactattttagttttgtctaaatccaaaatttatagaaattatcctcagagtgcattgataagcaatatatatgcataaatatatacacataaatatatacacacacacacacacacacacatacatatatatacattctctctcctcctctcatggtaatctaagaggcatgctgagtacttctactatcagggatctgggaggcagaaagagaagtataaagagaggcaggcagttgattaaatatgaatagcatgtattcattgataatgactatcagaaattagtttcctcacccaggtatcacctcccagatattcagactgctctttgaagctcagctcaaaccaggcagaaaactgaactgagaattaggaaatcagaaaacaggggccttagaaggaataacagtagtatagtacacactaaactaaagtcaacaatggggcaaaaagtcaacgattagtggggatatgggttacctgtagtcacgtctacacacacacagcatcaggtgtggaagcagtatagtctcatacacaactctggagtgcctgatgtactgctacgagacaggatctattagccctaaggttgagtgtgaacaaacctatgggtaatctataattatcacagtcatctatgtgtggttgtggcctctgcagaatgtcattttcacatgaggtacatgtttttactcaaagtatgcatttacaagatagctgcttgaatgaacgtcttagtccatcaccattaaagagagacaaacagtaaataaaatatttaaatcaatgttattggttgcattaacactatgattcaataaggtaagcccactaggcactgaagaaaacgctctaggtttataatgaaattgcatggtattaagagaaaatttaatagcagctaatataaacgcaaataaatgcattaagttagatatataaaacgaacattttctgaaacgctcaaacagaattacaacttcttaactttcagttttttctcaaattcattaaactcaaaattattttttaggttgttttatggaagaggcttgttgaacatagtcaaaagccttccttttgatgagattgtattcatttctagattaatgtcagatagataacagaatttcttataaacacattttaccaaaagtcaaaaaatcatggcaattaatttcatttatttgatcttaaaagtaagatgtctatcaaagttaaaaatgtgtcaacatatatttataagtgaacaacttctaaataattaaaaattactttgagataattttaatggttttagaaaaaataaatatgcttcttcctcagatgctttcagttgttgtattcataattaaacaagcaatgcttaatattcacagatgaaaagctgtcagaaaattatgccatcagaattcctgtaaacaaggtacttttgttaatttctaactgattgggaaagtagcattattgaaccataattgatttcctcttttctattttgtgcagcccagtggttgtcttgtgtggtgtgttattgtaagatgattgcttaatttgtggaatctaaacagcctattgtattctagtagtctcacatatttatatgccagcatgcactttatgtttgcagtcaggtttagaattttatgtcaactattatttcattatttatggtaaacaaatttcaaatttgagacattaagtatgatcagaaatattacagtagaaattaaataatgatttatttgttaaactatttttcttaatctatgccctgcagttcaattgtcaattgaggaagttttagaacacaatagcaaaataggaactgcagtaacaaagcaagattgccaagaagaaaaatgctttttaaattattcctttaaaaaaaagtaaaggtcaaaggagtgtgaccagtatctgatatttaaattaacctaagccactgaaggtattcatatgtatgtgaatgaagttccaaatgtagactgggtaaaaactccaaagcaataatcatgttggctacaataatgcatgcaaatcaaggtaattggtatagataataaataattgaggaatcaaatttaggtacattttccacggccagtaaaaactaagcataaagaacattaaaatagtttggttatttgtccctgcccaaatctcatgttgaattgtaatcctcaatgttggaggtggggcctggtgggaggcgttttgatcatgcaggcagatccctcatgacttggtgctgtccttgaaatagtgagtactcatgagatctggttgttttaatgtgtggaacctcccctcccactccctcttgttcctgcttttgccatgtgacatgcaagctcctgcttcacccctgccatgagcaaaagcttcatgcgtcctccccagaagccaagcagatgccggtaccatgttttctgttcagcctgcagaactgtaagacaattaattctcttctctttataaattgctcagtctcatgtatttctttatagcaatgcaagaatagcctattacaaacattaattgatttgattactaaagctgacagagtattgtgcatgaaattgatctcgatatcaagaagtctggtttcttataaaaagtgaattttatttaatagaaacattgagagatgcagtgttcaatatggtaatcagtagacacatggttgaacacttgaaatgttgatgcaagaggaactgaatttttaatttaaattaactttaatttaaatttaaaaactaattcatttgagatatttaaaaacttttaaatatggttgacaacttgatacatataaatatctattttcaaccttcagtttcatgaaatgtaattacagatcaattccaatgaaaagttatccaaattaagatgccctgtaaatataaaatacatgtcagatttcaaagactaagttagaaaaaaagcataattatttaaatactgttttaatagtgataacatattatatattgttaaacatattattcatattaactttacttatttttaatatagctctttaacaaattagaattgcatatgtggctcgcgtaatgtttttattggatagccttgagaaaaaatcaaaatctgcattgactttacatgtattactaagaatatgttttaggacaatatactctaatttacatatattttctctatcttcatacacatctgcttcccacttaccccacctcccttattgtttcccaaaaatcagaaattctgatgatgtaacctcccttattgtttctcaacaaccagaaaatttgatggggcttgaaagacagaagtgggataataacagagagaaaaatatcttagatttttcttttgtgtggtataatggtgcatttttattactatcattaattaacccagaatggcaaagaggaaaaggatttttgaattggaaccagtgaagagtcaaagaagaggaggaatgcaaaaattttcaggtggagaactctctgtctgtaaactctgttcccaatgaccactacaagatccatgttccctccaagagagctgagaaaacatcactacattcatcattcagaacagggtgagggaaggagccctcgacagaacacgcccagagttacaagttgtcctcagagtagtattattgccattaggaaaaattggccaactgtgagtacagtgtgaatgatctggaaagataaagagaaaggtagtaacaataacataattgttttcctggccatgtaggagtttggctgaagttgtccttaatgtgacttttttaagccaatgcttatttccatcaattttggtttcctactcaattctatttttatcagataagattaactcctatacatttactgaaattatacaacttttacatcttctctttcatggctaaagaatgaatctaggacttatctactgatattagatatcatcatttggcattgtctcaatatactgtggctcactatgggcagctcaaacactatattgcctctgcatcagaggcaattttgaattgatttgtttgggtttgttagtctcgaggaatctcaagatatgatttttaccaaaatgagtgtggtttctttccagctgtttgttaatttaaaaaaaaagaaatgaaaatgaaaactattagctaagttcctaaccttttaataaattggctagaaacacaatgtgctatttcaaaacaatgatattttctaatatttcataagcactaaattttgcatctttttacatgtactgatgccttagtccctcttatgttatttgaatttgatgaacaacctggtatctttatctatgtttaaaaatacatctcttcaggggagagcaaaagacaaacaaaaataattcccattacagtctcagcaggtagaaatgctcttactcaaaccacagacatttcttaaagcaggcctcacagctgtaatcttcaaatacttttattctaatagcaaggcataatgtggtaatttcaaatttgctttatcatgactgttttaaatggtgaatacatattttttctaagcaacagtatattattgaaatgaaaataatatatgtgatcattatgtgtcagatactgaaatgaccattttctatatctcagtagccccttttaacattccttctagtaaatcactatgatttctacttccaaggtgacaaaagcaagcttagtggggacccatagctaacctaaggcaacaaaacagggacatgttggagcctagagtcttccaagcctctgtttccaaactcatgcccttacttgttctgttagtctaattcttgtaatggccattatttgatattttattgtaaatttacaacaaatactttgctctattatataaaatactatcatttggaactgaaacttctcaatattatttaaagaaatcattcaacaaacagattttattttatcctacactatgttcactaaaaaactgagaaatataaattcattgatatgaatttcacttaaagagaattttgacagcacaaactttcacattgttttctttttgattggcaatatgaatttagtgcccaaagtactggttatttaaaaaaatgagattcattgatttttaatctacatttttctattcatcttgagattactaaacatgggtcacaattttaagaacatctaggaaaataagacttcttgtaacaagaactgctgaaaaccctttacttcaatttgacattttgtgctcttctaaatgtatcctaatgcatggtcatgctacaaaatgactatcattagggctgtcacaggccatggctgtgggaataccatgactgatgctaagctatcagcactgtcggtgcaaggtgtattctcagtaatttctcaaactgtccatggaaccaatttctactgatctctaagtcataaaactttacaattaccctgagttcattaataatgtattacagttctcattctcaatcacaatttcatcagatccatgtctcacaggaaggttgacaagtaagccacaaaattatccatataaatgtcaagatttattttcctaacataaatgatctaacctagtcaagcatagttaataataaaatcattctttctgagattaccattcacctgattgccatacccattttggccttatatctcaacctctctaatggtggaggttatggatatagtccacataaataaaccaattatttatgagtcatgttcatttctatattaaaaatacaaaaccatgaatacttatattattgcttattactcctctgtaataggcacaaaactaaattggtcaatttattccatgacaatgaggtaagtactaaaagggaaaaatatgttaaaacagtaattttagttacagatatctcaggttgctgttttagcaaaaatcataacatactctacttcaaatacagaatctcagaatatgtccaaatgggaaattaagtattaaggcactggcaaaattattgcattgaaaatgaacagaaacttgcttctacattgcatttttcctacactctgtgcataaaagtttattttgataatgaaggatatatgtaataaacagtttctgagttcttgaagctattccccccattgttacattactatcagcctgttttgatatattatattaatcatatcataattttaaaatatatgattttttcactgatatatgaaatcttaagtaacatattaaataactaattacagaaacatttattaatctaagtaaatgcatgcaatggactgtaatttatttgctttgaggcattttatagaagtaaacagatagataaaagaatgcagatggggtttcagaagcggcatattgataggcgaaatactatactatctttcaagactacaagtggagaatgttaatatattctgccaaattttatatactgtccatcttaaaaaaatcacattgtttagagtagtttccctcctgagaaaaaaacaaagttggtgacaccacttgacagctccactgaagcaggaaacataattgcattcatttattcattttctcagtattagactcacgaacctttaaaagggtggggtggggagtccttcaatagaagtccttcagtagaaccaagaaatcagtattctatgatttactacttcataaaggtaaataagtcagtgaattaatcaaaaatttaaacagtgtatttttctctcaattggctatacaacctagaatttatatctcctaaaggtaaattgataatataaaaatctataggtagcatccaacattatgactctttacatgactgtagaagttgtgatacatttagaattattgttagcaaaagtctatgtaatacagcatatttgttttgtttcctagataaattgatttatattcaatgatttgtctgtagcagataaaataaaatacataactgatacctcgaatattattttgttttgataactgttactttttcaaccctgttttcctaatcattatctttatttcctcctattaagaatactttaatcttactcattttctgtctgaacactgaaattcatcaatgagagtaaacattgaaccaaaaaaatattccttttattgagactggtctctaagtatgctttctattagagttttaattaaaatcactttcataatatacttttttatatttgtataatatatgatactatatttgattttcctagtattaatctgaaggtgataattttataatttgccaaatttttatattactctaagccataggttgacatgtatatttctcagatataaatgttcatatgtaccagaaatatttttaaaagacatattagaatatatatattttttaaataaaatatgctgaaaaatattttcatttctgaaacttcatttatctttggcaagagtcagtcagtatctcatgattaattcagggctgaacccaaacgacgttcaaattagcatgtcagcagaagaaataataacactatttgatactggtcttttcccttagaatcactcaaaaggttctctaagacagcacacagagtcctggttaacttctgaaaacattctttttcactgtaaagccagactattgttaatgacaattgccattaatttactatgaacttacatataagaataaagattctgacactgcattttccccaaatacgatgaacagtagaaaatcagtagaaaatattagagaaaagctatacttagaatccatgtaatctttagattgttaaatatctgtttcactcaaattgccaatttaaatgtgggctttcttctgaaacagtaaatgctactccaagaaagtaaaaccagtagtgaaattttattcattttactttttaaaataaaaataatatctgccctagagcttattttgtcaaaacatcttcttcactgtcgtgtatcctatggtatgcccttcctattctaagtgtcagagacaaggaaccaaatcaaattcctcatacccctggaaatgtatcaggtttttacttccctacaatcatctacaatttaaatgcaaatttaattttgtcagcatttcatgacattgaacgtagataaatgtctcactatctcagtgagtgttatgaaagtttaaaaatattcttgaaataaagttagtgttttagttggaaaaaactatagcatacagcatgctgaaacagaagaggatgtgcaagaagtgtgtagtagcatgggcatcattgtggaggaataagaaagagggtgtgttgctgggacagtgaaacacctcatcctgctgtctaaatctcaggctatattcctaagggagagcatctgggggttctccactgattgaattgttagaattctgagaatactggaatcaaatcttagaaaaaaactgatttttagtctgggaatctaggtcattagatgtctcaactggtgaacagaagaaaattataaataagaaattatgagtgatgagtgaagccagaagtcatgacaaaggtgaagagtaaaactaagaagtactggaaagttaatgaggcaccagacatctcaaacctttaatattaatcttttagtgaggctcagccagagctttcttgcttttatgacaacattcaatcagagagtaatcatatctcacagcatttgtgattgatctgaagtaaggatctctatttctcagtgttctttctcacttaattttctgtttggttttccctatgatttcatatttgaacctcctttcagtggaaagaacatctgtagtcccatgaattttctaatctgaaagggctacagaaatgaaccatcactgtgcttcaagccagccagaacaagatttatcacttgctttgtgtgtgatcttgaataggtggcttaaaatgaaataatgcaattcccagtttctgaaagtataaaaattaaataggataactgaaatatgcccagaaaaattcaaggtaacagcatagcttaatctccctcccttgatctaaattgtttgatgacttttttaaaaaaaatcttccagaacacaactcagatatcttaactcaaagttcaaggctttccatagtgtctcatccatctgcctttccaggtccacttttctctattccctttacgtagctttttgtttagtcaaatgggaccatttagtttatttttcttttgctatgtctgcctttgctcttgcttctttctccaactctatacttgcatagttatcctttccttcaaggaccagctcaaatattactgcacttctatatttctctcccttcccttcccaaaattaatctctcccttctctacgtctataaaaacatttttttgtcttctggagtacctggcttaatgtatcctcaccttctcctctttttttttttttttaaatccttctctattgtctcatttcctctatagttttaaatatgatagtttgaaattaatagatgatggcaaaaagaagactacagtacatggtgaaaccccgtatctactaaaaatacaaaaattagctgggcatagtggcacatgcctataattccacctatttgagaggctgaggcaggagaattgctggaacccatgaggctgtggttgtattgagccgagattgtgccattgcactccagcctaagcgtcagagtgagactccatctcaaaaaaactaaataaaaaaaaaagaagactacagcttacatttgtatcttagccaaagcagcttctttcttctaagctatgctactgctgcatatgtttggtcaaaattttaggctttcatggtttcttttttcctttttggggggatgtgtatagcatagatcacatatggaaacaaacgcaaaacagaaaatacaaatgggaatgaaaagggaatggaagcagagatattatttccaaaagcttaaaaggagaaataaggattgaattgttttaaactgaagaaaacatcatttatatagaaagagcaattagattatgcgatactggtaaaacgagtcagtggaattagttcacagaattatgaataaaaggtctgtctgcattatgtcttccttaaatctattgtttgttaaatttccaattatgtacatgagcataaacacacataaatacagatatatatgtgtgtggtggtgtgtgtgtatataaacatttgtaaatatgtatatgtgggttttttttttttaacggagtcttgctctgtcgccaggctggagtgcagtggcacgaactcggctcactgcacctccacctcccaggttcaagtgattctcctgcctcagccccctgagtagctgggactacaggtgcgtcccacaacacccagctaatttttgtatttttagtagatatggggtttcaccatgttggccagaacagtctcaatctcttgacctcataatccacctgccttggcctcccaaagtgctgggattacaggcatgagccaccgtacccagccatatgtgttattttttaacgcggtaacataatatccaggttaggatgtttaaggatggatatgtgaaatgtgttttccatcctctcacacactagatcccatatttcactttaacaggtatcatatttctcccttttcattattgcagatcatcctgaaagcttcatcacctttggtttggtttattttccattattccaccaaaatgactattttgtttaggccattggtgccctcttattgccaaatccgatgggtatttgaatatcttttcttagttttcctgtgtgcagcattcaaaattgtcaacaattccttacttcttgaattagttccacacattggctttatgatactacacagctgtgcatcttacctaactggctccttcttctcattcttttcactcttcctctttcacccacctcatattaattggaagactcagctgagtggtatcagatgtcaacactcatagcagttgagtgaatgagtggtgtagtcctgaagtggagagatctgagccatgggccagaatacacactaaacccctcatgtctattaagtgagtactaggcaccaaaaggaatatgtatatttgcttgaataataaatgacctctcataggcttccatttgtgattttctgatcacattcttcatattctatcattccatgcacatgtctaagctcaatgatatggtttgactctgtgtccccacacaaatctcactttgaattgtcatccccataatccacatgtgttaagggttggaccaggtggaggtaactgaataattaggacagttttccccatgccgttctcgtgattatgggggagtcttgtgagatctgatggttttataagagtcaggcatcttccctgtttgcactcactccatactcctgtcctgtgaagaaggcgtctgcttctcctttgtcctctgctattttagtgagtttcctgaggtctcctactaatctggagctgtgagtcaattaaacttctttcctttgtaaattacccagtctcaagtatttcttcacagcagtgtgagaatggactaatacagtaaatcggtaccacagagagtggggtactgctataaagatacccagaaatgtggaagcaactttggaactgggcaataggaagaggttggaacagtttggaggggtcaaaagaagacaggaagatgtgggaaagtttagaacttcctagaaacttgttgaatggttttgaccaaaatgctgatagtgatatgcacaagttcatccgtaagtggtctcagatggagatgaggaacttgctggaaaatagatcaaaggtcactcatgctatgctttagcaaagttcctgatggcattttgcccctgccctagagacatgtagaagtttaaacttgagagagatgatctaggttatctggcagaagaaatttctaagcagcaaagcattcaagaggaagcggggcatgaaagttcagaaattttgcagcctgaccatgaggtagaaaagaaaaacccattttctggggagaaattcaagcctgctatagaaatttgcataagtaataaggagcccaatgataatcaccaagacaatggggtaacgtctccagggtgtgtcagagaccttcatggcagcccctcccatcacaggtctggagggctaggaggaaaaaatggtttcatgggccaggcccagagtcccccttctttatgcagcctcctgacatggtgccctgagtcccagctgcttcagctccagctatggcaaaaaagggccaaggtacatctcgtgacattgcttcagagggtgcaggccacaggctttggcagtttccacatgctgtcgagcctgtgggtgcacagaagtcaagaactgaggtttgggaacctctacctagatatcaggggatgaatggaaatgcctagatgtccaggcagaagtttgctgtagggccagggtcctcagggagaacctctgttagggcagtgcagaagggaaatgtgggattggaacccccacacagagtccccactgtggcactgcctagtggacttgtgacaacagggcaattatcctccagaccccagaatggtagatccacctatgactagcaccttacacttgaaaaagctgcaaacactcaacatcagcctatgaaagcatccaggagagggtgctgtgcctgcaaagccacagaagtggagctgcccaaggctgtgggagcccacctcttgcatcagcatgacctagatgtaagacaaggggtcaaaggagatagttttggaacttaaaggtttaatgactgccctattagattttgaacttgcttgaggcctggagcccctttgttttggccaatttctcccatttggaatgggtgtatttacccgatgctggtatccccattgtatctaggaagtaactaacttgcttttgatattacatgttcataagtggaagggactttgcttgtctcaaataagactttggactttgacttttgagttaatgctgcaatgagctaagactttcagaggccaggcatagtggctcatgcctgtaattccagcacttctttgggaggccaaggcgggagaatcacttgaggttaggagattgagatcagcccagccaacatgacaaaaccccatctctactaaacaaatgcaaaaattagccgggtatggtggcatgcacctgtaatcccagctactgggtaggttgagtgaggggaattgcttgaatctgggatgcagaggttgcagtaaagctgagatcacaccactgcattctagcctgggcaagaaagcaaaaaaaaaaaaaaaaattatatatatatataaataaatacacacacacacacacacacacacaaacacacacacacactttgggggacagttggaagggcataaggccataattctgttttgaaatatgaggacatgatatttggaagtggtcaggggcagaatgatatgctttgtctctgtgtcaccacccaagatctcatcttgaattgtaatacccataatccccaggtgtcaagggcaggaccaggtgaaagtaattggatcatgggagtggcttaccccttgcaattgtcatgataatgagtgagtctcatgagatatgatggttttataagcatatggcatttccccttcttacacttctttctgccaccttgtgaagaaggtgccttgcttcccattcaccttccaccataattgtatgtttccttaggcctcacctgccatgcagaactgtgagtcaattaaaacttttttctttataaattacccagtcttgggtacatctttacaacagtgtgaaaatggactaatacactcaccaaatacagtaaggtctttgtggattagaaatatactggatttgactttatattctctacattgcaaagcagagtaccttgcatatagtatgtttttatttaatatttcctaaatgaatggaaacagaagagaagttaaaggataagtcatgggagcggctgatgcagtctctaccagtgtgtcataaatcccaaaatatttgaaagaaattatagtacagggatccacaacacaaagctgctgtcccaaagatccatttattctatttacttgtcaaagtaatagacaaagtaatagacaaagtaattgacaaagtaattgtcaaagcaattactttgacatccctacactgtcattttctggtctataaattaggggtagtaatactaacctgtcataaggtctgagaatgcaatgctctaatagggcctagaacacagtaaatattcaataacatttatttgttattaataaaaccttcatgaagttaatatttcatgtataatattctgtacctttttcttcctttaaaattaattgtacatgattaaacatgcattttttagagtataagaaataaacactaattgttaaattatatttgttcatattctggattaggagaaatttaattctcagtttgtattataaattttaaaaactgccaggcacggtggcttaagcctgtaatcctagcactttgggaggccgaggtgggtggatcacctgagatcaggagtttgagaccagcctggccaacatggtgaaaccccatctcccctaaaaaaaaaaaaaaaaaaaaaaaaacagattagctggacatggtggtaggcacctgtaatcccagctactcaggagactgaggcaggagaatcatttgaatttgcggggcagaggttacagtgagcttagatcactccattgcactccagactgggtgagagagcgagactacatctcaagaaataaataaataaataaataaataaataaataactgcttaataataaaaagaagttagataattcatacatgtattttgttacgattaaaaataatctgacaacaaatgagctgaatatagtaattatgaaatcaattttatggtttgttaaaatgctaaggttaatcttcacgtagtttgagtttttattgtatttatctgcttcataattttgattagtgtaaggggaatggctgtggcttctgtctggagtaggccaaggctgacatccagtacagcacgacacagcgggtttggagcagaggcgcacaaccccatgcactacataattacatttatgtagccattcggttgtaacctgtttgtgtgagctcatacctggctttgagccactgttgtctgtgaaaaatataactgcactgctgactctgtaggagagagaaagaataagtccacatcccacctgcctacggtccctcgagtgtttttcagctacccgccacccatctactgacttccctcggaccccagcttgggttgaaatctgaaaattaggttaatataacttttaatattgaaaatagtatttattatagcttttaatttatatttttgtgaattatttgacccaatctgtgtaagaagatgtacattagaatataaaaatacaattaccagaaaaataaaagataatttttggttctttcatgaaacatagaaactcaagaacgaaaatgaataaagctatattcaatccagtcagtcttgaattcatgtaaaatttttagtacttaacaaagttgcaaagattcatactattaaaacagaaaagttgtagaagtggtctaacaatgaaattctcagaaagttagaattgtcttgctttatttctcaggcattcctaacattatgatttctgtgacaaaaagtaataactactcatatatttaccagcgcctgaaaatcaaatgtgttataacatgaattatcatagaagtatatgactatgcaattgcaaatgcaaaaagtcatgcaacacactattttaataatataacaatcatcttactgccaatgttttcatttcactaatttcattgaatcttatcttctgataactgtttagctctttaattagatatcaaataattacacttttgaaatgcagccaggcatagttttttagttgccgtgatagcatatagtcatctttatcctgcacattttgtgttttatatccaagcacgtatctaattatctttctgactgaattgactacttacagcgcaggaagatctaacacaggtcatttgcaattgtgcagtcacaagtcacaaaaagaatgaaaaagagtgaagaaagcctaaggttcttttgagaaaccatcaagtgaaccaatatacacattgtgggagtcaaagaaggagaataaaaagagaaaaaggcagaaagcttatctaaagaaataataaccaacaacttcccaaagttttggaagcaaatgacattcagatttacaaaccccctaatacattgatgcattatcatcaaattatcagaagtcaataccaaagataattttaaaattaataagagaaaagtgacatcacatacaagcaaccctcataaaactatcagttggtttctcagcagaaacctttcaggcaagaatggagtaaaaggacatactcaaagtgctgaaagcaaataaaacacctaccatgaatattatccccagtaaacctgttcttcataaatgaaggaggaataaaacactttcccagaaaaaccctgagagaggtcatcaatagcaggcctgccttacaagaaatgctaaaaggaattctgaaagaatactaaacagcaaaatgaaagtataaaacttaatgagtaaatgtaaatacatagaaaaaacaagaatactgtaataccataatgatagtagataattctaatataaaagttaaaagacaaaagtactaagcataaccacaaaaatatgttaatgtatacacaatataaaataggtaaactgtgaaatcaataagataaagtacatgcatggaggtaaaagtgtagaaattttatactgtttgaatttaagttgccatcagcttaaaatagactgctgtaagacaagcatgcctcatggtaaccatgaagaatatatccctaaatatacacaaataaaatatatcagagtatgtcactaaaaaacaaatataattccacaagaagatggcaagggaaggaaatagggacaaaatacctataaaatagatagaatataagtttttaaaattttaattaaaagtcctcacttacaataattactttgaatataaatgaattaaacttcacaattgaaatacatagagtgcctgaatagatttttaaaaataaagatctaactttatgctgtctataagaaacccaccttagctttaaggactaacacaggctaaaagtcaagagatggagaaagatatcccatgcaaactgcaaaccatagagagcaggttagctatacttgcatgagacaaaatatatttaagtaaaaaggtgttacaaaaatatgttgataagttttatttagttagttcagaatgtatacatgtttgaaaacatcatattgaacataataagtaataactttcacaggaaacaaagaagattatataatgataactggtcaattcatcaggaagataaaacaattacaaatatataggcacccaacatcagagcacctaaatatatacataaagcaaacatgacttatatgaagggagaaacagacagaaaaaaatcacagcaggagattttaatactccacttcaataatgaatgggatatcttaacgaaaaaaaaaaaaaaaaaaagcaaaccgaggactaaaacaatactatagaccaacgggacctaacagacacatatgaaagattccatacaatagcagcaggataaacattgtttttaaacatgcacagaataatctttggaacagatcacaattgaggccacaatacaagtcttagtaaatttaagaagattgaagtcttaccaagtattatttccaaccacaaagaaatgaaactgagaataacagaagacaaactgaaaaattaaaaagaaaaggtaagtaaatgatacaatcttgaacctacaatggtcaaaaaagaaatcaaaatagaaattagaaactatctcaaaatagatttttttcttaaaaaaattaaaccaacagaaaaacttaaggcatgcagcaaaagcaatattgagggaagtttatagttataaaagcctacactataaaagaagaaagatcttaaacaattaactctatacctcaagaagctggaaaaggaataacaaattaagcacaaaattagcagaaggaaagaaataagatttgaagataaatagcctagagaaacaagaaaaaatgtcaacaaagtaaagagttggttttctgaaaagataaaattgacaaagctctaggtacatgaactaagaagagagactactcaaaataaaaaaaataggagatattacaactgatgctacagaaataaaaataattaaatgagactactattggcaattcctcaccaaaagattggataacctaaaagaaatgtataaattcctagaaacatacaacctactaagacttatcgtgaaaaaagagatagcctgattaggccaataacgaagaaaaagattcaatcagtaatcaaaaatttcttaaaaagccaaacctgcagaagtaaacagtaaaagggtggtaccagaggccgtagtattgggggactgggagatattagtcaaaggacacaaaatttcagttagacaagaataataatttcaagacatctattatacatcatggtgactgcagttaatatccatatattgtatgattgaaagttgctaagataatttaaatgttgaaagttgctaagagagtttaaaagttgtcaccagaaaaaaaaaaaagttaagtacatgaggtaatgtgtatcttcaataatgtgatttagccattctaccattatatataaatacattaaagcatcatgttgggcacaatgaatatacacaaattttacttatcaataaagtatatctttatctttctaatgaagaagagcccagtaccagatagcttcactggtgaactctaccagacaaagaataattaacattaattcttttcgttaacagaatgaaggataaacatcacatgatcatttcattagatgcaggaaaagcatttgactaaattcagcatgctctcatggtaaaatttctcaaaaactatgcatagacggaatttaagtcaacatgataaagactatatatgaaaagctcatggctaacataatattcaagggcaaaaaacggaaaacttttcctctatgatcagaaacagggtgagaatcgcactctcacaacttccattcaacatagtactaaatgttctagccagaacaattagacaagaaaataaaataaatgccatccaaatcagaaaggaagaattaaacgtttatctgtttggagatgacagggtctcatatgtagaaaaccctaatgatcccccaaaaatctgtgagaaatgataaacaaatttggtaaaatttcagtatacataatcaacaaatgaaaatcatggcttttaaaaatttagttttttaaatggtaagtataaattacatatatacttaaaatcagttgtgtttttatatataaacaacaaactaataatgaaattaaagacataatttataataacattaaaataataaaattcttaggaataaacttaaccatggaggttaaagacttgtacactaaaactaaaaaatatgatgaaagaaattttaaaagacataaatacatggaaagacatgctgatttcatggtttagaagaattaatattgtaaaaatgtccacaatcacaaagtgatctacagattcagtgaaatccctgtcaaaatcccactgtcactttttacagaaatagaaaaaaaaattgtgaaatttgtatgataccacaaaagaaccctcatagatgaaacaatgttgaaaaagaataagctggagacatcatactttcagaattcagatattacaaagctatgacaattaaagtaatttttggtagtgttgtgttagcataaaaatagacatatagagtaatcaaacagaatagacagcctggaaataaactcatgcatatttggtcaattgtactttaacaactatgccaagaatatacaatgaggagtgaaatgttttcttcaacaaatgctattgagaaactggatatttacatgcaaaataatgaaattggacccttatcttacaccctacaccaaaatcaactcaaattgggtgaaaaacttcagtgtaagttcttgaaactttaaaactcttagaaaaaaattatgaggaaaagctcttgacattggccctatcaacatttcttggatatgatgccaaaagaacagccaaaacaatagcaaatataaagaattatgactacatcaaagtaaaaatcttctacatagaaaaggaaatgatcaacagcatgaaaagacaatggaatgggaaaaatatttgcaaagcccatatctgataaagggttaatatacaaaatatataaggtactcctacaattcaaaaacaaaatcccaaataatctgatttataaattggcaaagaatctgaataaacacttctccaaagaagaaatactgatggccaacaggtatatgaaaaaatgctcaacctcacgaatcatcagggaaatggaaatcaaaaccactatgagtaattaatcgacagctgttaggatggctatgatcaaaaaacacaagataacaagtattggtgaggatgtagtgaaattggaatcttcatatactgttggtaggtatgtaaaattgtgtagtcactatggaaaacagtatgcaaaattcctctcaaaatggtaaaaacagtactaccacatgattcagaaatctcacttctgagtatccatccaaaataattgaaatcaggactcgatgaaatagctgtgctctcatgttcatttcagtattatttacaataagcaagatagggaaaccacctaaatgtctattgatgataaaatgatggtggatggtgaaaccaagtgtggtacatatgtacgattattcagtcttgaagaagaaggaagtcttgctacatgcaacaacatggataaacctgaaggacattatgctaagcaaaaataagtcagccacaaaagactcatgttgtatgattctactaataggaagtacctaaaataaaataaaaaaaaaaacaaagtacaatagtgattatcagatactgggtagaagggaaaatgggagttgttcattgggtaaaaatttccgttatacaaggtgaatgatttctagaaatctgctgtactacattgtgctcatacttaacaaattttccctgtaaaatattatgttgtttctgtgtgatgttaactaacacaagcacgtatttttgcttttgtttttaatttccacttttaaataggatcgtcatatctcaaaatgtcctaccaatatgtagggacagttatctcggaggtaacactcttttgtaaaatgcagataaaaggaaatgaaaaaagattctaaggaagaggcgcaatataagaatgcttttcttttccattgcagtagtcaggatatataactggatagaattgcctctgtttagagaaataaaaagaatatattggaatcagtaaatgcattttctttgagtaaaagggttagcgcacagatatttgtaactttggagatgtcactcctatagcctcggggttttagaagcaaattctgtgcttgagatgaatccagctgagatcctgtttctcttaatatgagaaagaatgacttataaaagaagatttaaagtacttgtgtaagctttgaactagtcaagctgaaacttaactcccatttcgtctagtaaagctcttagtgccagaatgttttctggttgtagaggataaatgacaatatgtaccagcagtaaattggcttatcttttggaccagaagagatactataaatggaagctaaatgccagttttgacaagttatgaatacaactcccaagaagccaaatacatttttaggattctgaacagctttttcttatgtagtaattagactctggtagaacagcaactaaatggtgtttacaacattacaaataaattttaatttcatccatatcatttcaccccttaggctgaagagtgatgaaacattatttatacttctattcagttctttctttttaagtggaggaagagctaaaggcaaaattcctataaacaaaaggaagctaaaattgaaatctgtaaggaaattataaagtttaaaaaaataataacaattttttcatatatgcaaagaatagcagagtacatatttatttctttgtatttgcagaaacaccatcaagctaagccatttgcaatgtaaatgtttaatctaaatattgtatagaccaaacaagaaatgaagattatgtatttcaaataaaatacaacaccagtaaagaatatatatctatatatatacataaacacacacacacctatctgtagttaaatgtgagagaaaagtatgtgttcaccaaattcaaacaccttaaataatctatatttataaattatatgtggcataggtcttagtgctttatgaatatacaataaatgctttgaatagatcaaatgcctacgaaaataataaagagagtgtcatcttaaaaggtgttctagtggcaatggatattttgccatctacatttatgaataaaataaaaatgtcatcaagattacatattgagattcattctttgataaacagcagggagtaagaaaatcatattctctaatatctggcacatatttgtattgctgtttcaaatagagagaagaataattaaaaagaaagaggtagtacattaagataaactttgctaaagaaatactaagtacctaaaaaagtagatgaatggcacagtattggggttaaacaacatggggatgaacactgcaaaataaagaattttgactcaaaacagtagattcagctaatataactgatggaatttccagggtaatgggaaatactcatattaaatgtgagattataagtattttgaaatatgtttaagtatgtgggatgggcatgaaatagagtatactttctactacattaattgaaatgtgtttttattacaaaacataaaaatattgtacaccaacatatctccggactgctgcaaatcagagggtttggtaattctcaataacttattttatcaaaggcaaaagacaagagatgatataggtttcaagaacaaaactggaacaaattgatcaacacttcatggcaaagatgaaaagactgacaaagtaagatgtagtgacaatgacatgtgattatccaattatctgttggaattctcatttacataaaaactagattgaatattcttgataagccttctcccagttgatatagagaagatactttagatttaattgttaccaattaagaactatttacaatgaaccagagatgaagggcacctaagaaaaaagtaaccctatgaccttttgtgcggacagttcacgattaccagatatgatgcaaataatattataacagcattctgaaaaataggcattaaaaatgttaggatttcttggtacaacatcatagatcacttcaagctaatggtcaggtttttgtccttaataaataaaagaataaaggtacaagctttttgttaagtctgaaaaagaatacctgacaattttaatcagaagtttttttaatgaagaacaaaaaaagagtcataaggcattctaagatgaatgcacattttaaaatgacattcaaagaataaaaaagaaagtcaaggaatctgtgccacatattgctataattgagtatcacatcaaataatatgatttcaatgataacaaagatgtttggaaaaattgctaaaggtaacaaaaaaaggaacaaaattatgttgctgtctaaacagaaaagaaaatattctatagtacaaggcttgagagactttgttatattttgttttgttttgttttaatataaaaggaacctgttgtcaaatgacttgcccaaggtcatatggttgttcagaaacagaattggaaaagtctattgctgacttcgtttgttttaccaaatcaaaactgcctctataaaagctccaaaaaaaaaaatagaatagagacccaaggtatatcataggaatcttaagatacatgaaagctgacaagaggaagtattaattggtcttgtttttaatcactcaaggaatgtgattagaaaggtagaataaaaagatgaaattaatatgacaatagatattcactccaatattcaaagatgaaatgagatacctttgggaagtactgaattattcctctctcaaaatattcacacttgagtaataaatattagtcagaaatgcaggagttgggattcaagaatcattgggatggtaagaataaataaaattttgtatctgagaagtcaataattaaaattacatgtcaaaaggaatgattctggggaagtggcaagcatttatttacctgagaacttaatagcttaatttcctaagaatttgagaaccgttcaagtaagccttagtttgaaggctgaggaacgaggcaatataatattgaaaacatttgaagtttttaaattagttaatgagccactacaaattacaaaccactgtgtgcctgataatatagttggtaccttgtaagtgaatgcaaagcaaatagatgaaagagcaaattaacttttagaaaaagtatttaaaaataaagtggtccttcttcattactcagcttttcattctaaatttatcaacaggccatatgacgtattatttgttttcattttcattactccacttaaaaacatgaattttgtttacatacaatattaagaaagaaacagccaaatctaaagcagtaaactacctcagataataaatagcatttattcattgtgttctgtttgacctttatgtacttacttcttggtttgtgagttgatgagagatctctaaattacactgtcctggaccaaattgcagagtaccttgtctgctttctgacttggagtcacagttcatcttgaccttgctattggtataagtatcagattgggtaatgaccttatttttttgctatattgcagtccctagttatccacttggcatttatggtcagcttttcatttacagcctggtgctgacattccccagacaatactgtatgttaccctattagcattagtgctcgctatccaaaatcatgcactaacataaatcctccaggtctcccagacacattgtgctgtgaaattcttatgaacttgaaacaatttaccagataatcaactgttttatctaggagtataccacatcattattcacatacctgctattttcccactgacatgaaacatgttttctttcaaaagtcaaaagaaaaattaattatattttattgtgtttataagagcaaattactttgtgaggcatagaaaaaactatctttgaaacatagcagtacaattagacttaagcaaatagcacttgtaagatttttgaagatatttgatttctattctatacctttaatgactttgagaaaatatgtgtagcttgcatttcaaccatttaaaagcaaaatgacttacattaatattaatttatatctcctgaagcatatcactcatttttaacacagcattatgcattgtcatatttattcgatgctaattttttaagtgacaatattctaaaagcaattagcaattttattgtagtacaaaaaatagacaaacccagtattcatttcatttttttaaagtcaaagaggctgaagaatatcatggctctttctactttttttatgtagctataaacaataggcaaatatttatacagaaatttaatttcctttaattaaatatacttcaatgtcctaatttatgtataaaatataatgataaataaaagtattttttaaactttaaatttttggggaaagtttaacaggaatgaatttcagttcaggcttgataatttcacacagagaaataaaaattaagttaaaatgctgaattttaaaactctgctggcatatcatgacagcttttcagggaaaacatctattttcctttaataagattatgaaaattaaagctcattattgtgttacaaagatatagtttaacaaatgctattaatttcattggtcttaattgttttattaggatataattatttaaaggtgacaacattcataaattagttttctttaaatttgttcaattgcagatgtgacatgacatgactgtacaaaagtgtgtggtttaaacactggtcacctaacttattaaggatctattttgtttttcttgttttaacatatggcagtagttctcagagtgtggtctttgaggttggcagtatcaccatcacctggaaacttattagaaaagcaaaatctctggcctctcatcctagctgactgaatcagtaactggggagagggtcaagcattgttatgtcttaacaagtccaatggataattcagatacacattaaaggtcaagaatcattaacctatgagttttcagctgtggtgtcatattagaatgatcagaggtgttaaaataaatacatgcataagtcttatgctataacaattgaaataaattatctggtgagaagacacagtacttattaaagaaccatatttctaatgtatagccagggctaagaaccactgattttacctaacatccaatagagcttttttattcctttttcctttctctggacctaagagtgttctttcactgaccttttcattcaaaaattactatctgatcaccagactctaatagtcaatgccaagtcttcccatttttgcctaacatcctgatgggacccatgctgttgacttattttgtattgtaagtgacatatcaatttaaataaactactatatccatacacaaataacattgtattagtgatttttaacaaatacaaaggtgacccacaaagttcactgcttctttaggctactcatcttatcccattagatcttttttccagtaagtatttagatgatgttatgcagtaaaaacgcattataagtccactgaatttcctgctcacttaataacctagcttgttcctactatgctactatgctatagcattaatagtcacccccagaatcaaaattattacctaacaatgagattatgaaaatgtaatgctaacatagaaatgcagtcaggtggtaattcttcaggcctaacaaactcccagtcatgctagggatttactggtcattaaaaatgtttgaatgtccagaaattttaagtatcagtttcttttatcttgttgttcatgactctaagttcagtgtttctcaaactgttgtgatacctaagaattaacaacaaggttgcattatagaacattataaatacagtactttatttgtgaagtagataattttcaaaggagtttatgttaataagatgcttaagtattaaacattggaagtgattacactatcatcacttccaatgtttttctaaagcaaaaatagttaacgattcttttctgaatgttacttatgaattcatgctttgtgggagaaacagattattttacaaaatgtcttataatgtgtccttcaatgtttagaatgttgtttctttactatatttaataaaatatcaattactgacacattttaatttacatctttcacataccatttctaaataacttcattgcaaacctcatagtatcaagcccacaatttgagtaaatgctaacatattttttgttgcttcaagtctctcttactcatcctaaatgcagatgttgaaaagtttttaaaatgtaagaatttttctcatcatggaaaaaattggaagtaactgttttactcaatatcttcaggtttacctacaagtttcttaaatgcccagttccagttcacttcttatcaactcacttcatgtttcttttctttctttctctcctaaaatgcatatcacgacctcatcttgtgtaatattgtgacctctcttcaaagtttgtatcgaatacaaaatcttataaaaattatgcgtttatttatcagcatgaaaccctaatcatgtagcctatcaaggttatattttctttatattttcctttaagaatttcagaatgatacacttttatcattgtaaatatgtggattcaaataatatattttctgaaaacacaaatatttagctttcaatgccacatttaatgaaatcacatactaattttgtggaagactgagatgttctaaaaagaataagaaatcatgaaaatatttctgcaggcaaacaaaattcagtctttccactagtctttccacacatgtgtgatatacatgtttttccatggttaaaaaaacatgcacactacacatgttgatataaaatgtttccttttaactattgttttgaaaaaaacttttgaataatcacatacaggatatatatgagtatgcaggtttgtatgaattttatgaaagacaataattactaaacatgcaaaaatcaaacaattttaataaccatgtatatgctagaaatcagctttgcctctactgaaacaatttcttcagtcttctactgactacattcttataatgttgcatttcagtaacttcaaaattatattgaggaataagtaagtgaaaattgtaattatataaaacaatctataatcataatgtagtggttatatcattatatacacacacgtacacacataaactatttttctgaaaaaccttgttttcctttcctaaaggaaacataaacatgcgttatggttttcatttaatttttatttaagtatttcttcgaccacgcattttacagaaaatttaaatgactatacatttttacatttctgtttatttgttggaaatagtcacatttgcatacattttattatttttgaatcttgacctaatcctgtctgtgaaaccactgcggtgcactatataaagggcaagagagatggggtgagatttgaatccctattccgtgaatgatgtctgtacttctgaatttcctaaatctgaagagattcagagaaaaagtcatgagtatgtgattcctctttgaggagacaacatgaacctgtaactggaggttaatttacatgctattgctagagcaggaaaattatatctttggagagattaattgaagagcataaatctttactcatatgtaaggaaaaagcagtttcctctagtagctaagaaagcaaaaaagatgaaaaagttgattcatagatgaccatggagaaagatagtgaagttaggaataccaacaaaggtgttagcaggctagttcttacagaccatacagcagcataataccattatgatctgaaaaatcatgaaaatggggctacttactcagtaaattctggaattgacctttcattggagaaaaattagacacaaagaaactcttacgcagtatggatagatgagaatattaaaagacttcaaaaaatcttgggcttgaaggtagtacgatctctagacgtatacttttggtttatttcctttcttttaacataacttcctttcaatagacacaatacatatattataaaaatttcttcctatgacccttattttttctttacttgtaactgaggctattttaatttcatgtaatgtgacattaccactgaggttgttttacttcctttttcacgtagtgcccttaaaagaagaaaacagatgtcttaaatacataattatatttgcctctcaaaataactttgttctgttgttatcactattttacacattagaaaactgatgttcaacaatgttacatcagcctacaaaaggcatacctacgtgagcattaaagctaatatttgaaaccgacactcttgtttatctgttatgttttcctgatgcatcgatcctagtataatcatgaagcgtccttatataactctggtaacacatttcttttgaaattggctttttaaaatattaatatagccacttcagacattttatgttcaccgtttttaaggtatatctttctccttctatttactttcagtctttcaaatagacctacataggtctttacatgtaaaatgcatttttgtagatactatatatattctaacaatgtaaatatatatgttgctatgaactgtgaagggtttgaaatgttacacatcatgcacaaatatttatagatagatggccactacatggctgggtttgagaaaaagaacttaatattatttatcctcacagcaaaatgaacaactgtggtaacatttcagtgctgctcctcacccccgctcctcccagccagcatcaacatagagtgatgtggtgagagtcacatgtagaaatatcttaaggaaacaccagctttcactcaataggtaagggatacaggagaaaaaaaaatgttttcagtgcttataaatggcagagactattcactttccccgattcctttaagggagtctttttggagaaacaatgggaagaatccttaattttaccttcgtcataaaaatacatttccttgggagtcagataaggcctttgtcttcagcttcaaatcttcaagagtctgggttgcatttttttttttttttaatgtaaacacctgggaagaaaactctccagctttcctcgaggactatttgcccacctttgatattaatgttattgttatataacacctacaatataattgattggctcttgggaacataaaagaaacttgtattatctttttaaatctgaacaattggctcccttggggaaacaaatggctgcgatctaacttttatggtgtaagaaaatgttcttgagaaaagtgagagctatactctaactttatagtatattataatgtattataatatattagattccatagctccagaggctgtggttttacagaacaactacaaaactaaaatccaggaaagatttattttcccacagtacagtgggtgtttttttttgtttgtttggttttgttttgttttcaatattctgacaatttctgccttttaatcaggctgtctcatttgttaatgtctaatgcaattatccacatggttggtttaagtctgccactttattttttatatactacttggttgccctagatattatgatttacatccttgattttttatagttcaattatagttaatgcaatatttcatgagaatatatatgaaaacattaaaatcttgctcattctttgttataattcttaaatgtatcacacatacaatcattataaatcctgtaagatgatgttatattcttgttttatacaatcatgtttttaaagaaattgagataaaataagaacaagggaaaatagtattttgcatttactagataattagcatttacaatgctagtctttctttactgaatatatgtatgactgttgacctggcacaattttcctttagctcgaagaacttctttttgactttcttgtaatgcaggtccgtttagagataaatgcctttagcttagtttaaaatatctctatcacttcttggttacggaaagatatttattctgtatagaatttgaggttgactttaaaaaaattacgcactttattttttttgagacaggagctcactccactcgctcaggctggagtgcagtggcttgatcttggctcactgaagccttgacctcttgggttcaggtgagtttcccatctcagcctccttagcagctgggactaaaggcatgtgccaccacaccagctaattttttatatttttagtggatatgggtattgccatgttgcccaggctgggatgcactttaaatgtgtgttcattttcttctgtctttcagggtttctggtgaaaaagacaactcttaattggatttttattaccatgtttgtaatatggcaattgtcttttgcagctttcaagaggcaattgactcttaataatttatgtttctcagcatgattcctttgtgtatagtctacttcatgtttgactaacttctgtctgcaaatttgtttcattaaatttgggaaagtccagtttatgatatgttcatatataattttttctgccctatgctttctccactctgttactaaaattatatatatgttggacatttgaataacatctaacaattgcctgagatcagtgttttttttcttttcaatatttattctttctgttcttcaccttgggtgaactctgttggtatacttgaaagttcactttctttctactctgccatgtgcattaagctcttaagtccacccagtgattttttttcaaatttcagaaattgtattttttttagctctagaacgtctttctccttatctcgctgagatttcctattactctgctgagaattttttatattaaaaacctattttgtctattttgtaaaacatacatgtaagataatctatacaaactatttttatttttttctttgatgatagttataatagccacttttagaatttttttctgttagttctaaacacatggttattttagggtcgaaactcttgattttcctttctcttgaacctatgctatgtgttcttggatttttgcatgttagtaattttggcattatattatagctattataaaagttaaattttagagattctaaatttcatcatttttctctaagtgttgtttctcttgttatagtagaattttttgtttgtttgttttggtaggattgaactgcaaacctttttttacttgggcggtagctcctatattatttcatacatttgtcattacaagagttgtcttgagtcttttctgcacgtgtgcttaaggtattagttgggcatgtgagaaggtaaagttttgagagccccccctttggctctttcccttttaaacatttccccattctttttaacaaatcctggtttccttacttcacttttacaactccttacataaaaaaaaaaaaaacacctttttttcatgtgtgtccctgtcacaactgtgagcactgcttgtactgtccttagacgtagtccaaagcccacagtgacagtaatttactctgcctacctacccttctacaggtaagcaaaaactctgctatagaacctgcctacttctattcaccctctcgtaccttcagatagttgcttattgtattatatacgtgttttataattttcttcagggatttgttcactcaattcctactgtgaaaactggaatcaaaaatgttattccctttttgtttaatgaaatagccaaaataagactagcctttcttctcatctgaagtgctcaagcaacttggtttataagatataaaacatctcaaactatgttcttggcatttttcctaatttttaagaattcacagcatctctattacacaaaacttcctgaaaccctttatatcatgttttgtgaagaagagcctcacatgaaaattgtcctagaaaaccagtttttctactatcttttacttcttacagtaattgcaaaattctgttctcttttcattccgtttacattgttcattcattaatcatttaatgacccgtaactatgttccagtagttgttaaattccaaaacaaaagaactaaccaggaagatccgaaccctgaattgtgttctttgaaagtagttttgaaaacaaatgtgtaagcaaataaattataaaacacttttaaaatggttattacacaagtaccaaaaaagctaggaaagtgaaggaaatttttacctctgttttaaggtggaaggtaaaactttatagagggcaaggacatttgaattcgttcttgaaaaatgacaagatgttttccaaataacatctgtggcatagagctttccagacagaaataagagtaaatagagataatcatttttccacgtatcatccctatttctctctgtggcttttttttaagccaaagatgcaaacattcatcatattaaagtacatattttaaaaatgtgtatctttttttcaaaataaatgtttttctatgtgtttgacatataaggtacatggaatggatgtagcattgtgtcaagatgcatgatgctaaactgataaaacttgtcctccatcgtcaacagtgcagtataaaaaatcattgaagattaaatcaattaatgccatgataaaatttatatattagaaagatagtaataactccggttatagcatagagaacaaatttggaaagagaaaattgtaacaaagcagaccatctaatgcttctgaagagtgattataaggatctgaactgcctcaatgataacaggtattgaaacttcagatcacattaggaaaatatggcagatggaattgacttggcagctaataggaaatatgtgcatagaaaatattaacgaaataagactccaatattttatttttagtaattacattaaaaaaaagaagacattttcaagatggaggaatgagttttatttagccattgttgagtttggcgtatatattataaattatgacttcttatatcatttaggaagaatatgtagacaacagaataacctgctttttattttttgtttgtttgttttggtaatttaccattattatttctcccttgtctctctctttccttaattctttaagtgtttcttaacccctgtttgttttggtttgttccaaccctagccctaacccccaaatttattgagaaaacttcctagcaatatagacaaaatatatatttattaatacaatgtatgtttattaattcattttcttttcttggatcaccaattattttgtcacaaaattctacataattggcacatcttacaaacctttattttggactgcctgccaaaatggcacccacatgggctgggtgaggtgactcaggcctgtaatccctccctattgggacgccaaggcaggcagatcacctgaggtcaggagttcgagaccagcctgaccaacatgatgaagccccatctctactaaaagtacaaaaatagccaggagtggtggcacatgcttgtaatcccagctactcaggaggctgaagcaagagaatcatttgaacccaggaggtggaggttacagtgattcaagattgcaccactgcactccagtctgggtgacaaagcaggactctatttccccccaccaaaaagttacccatgttaactttggttccatatactattccatagccacaattttcatctaatttcattatgttcatctcccagaaaaccttactcactttcaacttggagcttatttgctccagtatcaatgtgagatcttttaacctccgcttgagatatgagataactaagactctgcattttaacaacttgccaaacgcaggcccagagcagtttttctgatgaccatattaacttgctttccatcatagcatgctttctctgcagtcaaaaattgtgttattcttggcattttattatatattttctttgatactggatactaataatcatgaacattcccgagtatgcaaaatgacaacctaatcacaaaaaatcaaatataatcttttaaatcatttttatgatagattttcaaagctgcttaagaagaaaaatatcacctgatttgctgtatatatgacctacctttatactttctcaaatctcatggctaaaaaaagaaagtacaatagatagacctttcatctaattttcaacttgcgaccatggcctaagcttgtaataaacatcaaattctattaaaaactatgagaatgttaaaaataaaaacaaagaaaaacaaaatcaaattcctctgctctctctgctattttaaaaattctgaataggaaaaagatctacatagtgaaataaatgtgattcaataaatagcttacattacattgtgaattcctgtatgcttacatcaagttaatgcccagtaattcaattaaatgaacacaatttagaaggagagatttccttaataatgtagcagtgcagtttctgggtaaaatataaaacagtatttatggtcatttactcaaacctctactaacttcagtggatattactttatgaattttacagtatgacacaaaagcaagctcaatgaagcagctatttctctaccagttgaagataataaaatactttactaagtagtcatttgtattacagttgcccttcataaaatactggtgctgtatatttttactatttgcttccactcttatggtatgcaaatataatcattataccattttactgaagtgttcagcatgtttctacaccttctaaattggtgaaaatgaattgcgatagcatgcagtattaatataaaatgccaggaaaattgcccacataatataactctcacattataagatttaaaaatgtcagtttagctcttgcaaacctccttttagttgtgcacgtaagcagaaacatgaggcactaagtgttatatatcttttgaaaatggcccatctctctagggatcagaatagtaatactgcttgcaaaataatatttgcagaatcaaagagaagaatactaatctcagtgaaacctaaatgtattgctttactgctattgaaatttaggaaaaagacaagactctctctgtgaagaatacaatgagaaattgacaatctatatgatgagtaggtctatacatttccctttcaattttatagagtgtattgagatctaaaaaaaaaattgtataggtttattcctgagaaaatacagagttcagtcacataataatgcttttgaccaattttgaggcaaaatttaaaacgaggtagtatggatccttaagacaacctataaaattataagccatggtgcttcaaatggcagtatcttctagctgtattcaatacagaattttaatttttgaacaagaatatatttacttggaatgattgcttaacttctttcttcatgccatgttcttctttacttcttattcgaattcttatattgttgaatgaaagaaacaaacgtggcatcttttagctgtgtagggaattattgggaagacaaagcaatttactggttttgtttcactttttcctatgactaattttttcctgtaagtagctggaagtgagtagcacccacactacatgattgttaagacagaataagttaaacaaagagaaagacaggagaaaaactaaaatcagtcttttctaaagccagattcctctttgtaggtgtgattacagaggcactgtcaaatggcagctctgcaaagtactcttgcttattaaacgatggcactaagaaatcagcatgaaaatctttggtctcctacatagaactgaccttatttgtaatatctccatccaccaaatagggataacaaaacgtatgagaaacaaatataagaattactaatgaatatatttaatacaaataaaacattcagaaacctagaaatatccaacaaatgatagtttcactggtatcaaaaaagttactcactgtatttattctctccattacataaaaaatgttaaagtattctaaatacatgaataaaaatacaaagaaatgccaaatatatgtaactcttatgaaataaaacaaactatatttctttgccttacatttttatagaatatcatatttttttcttattaaaactcataagtagatttgaaaaaaaaaaaagcagcagcagcagcagcagaatctttagttccagaaggacttgaactgaaatcctggcattcttattctagacatttgggtaatctttccaaactaattttttttttttaaatttctccatctctaaagtgatatttcagggtggttactgagaaaatacagtagtattttctgtcctgtctgggatttagtaagtatctccagaagtggaaaaaatctattctatttttctccatagatattaatattaataaagaagataatactgtctttcttggataccattctttctttgtggtatgctatttctctgctttgaagttatttatccctctttgatgacagttctctacactccggagtcacttcttcaagtgatttcatccactattacaggttaacaaccaactgcatgttgattgctcccaaattcagatctctagattctgaatactcctatgtactttatattttaccacaattatacgccctctatttcacttacactattcatcaacttttctcataatgctagtcattcccctagtgattcccattaccctataaacttttctttggcaccactaaagttcatgttatcttttacccttgcatgttttcagtcaataggtagagctgattttacttaataaataatcctcaagctgttcctgtttctcggcctactacatcaacttgaattttcagtacctattacctgaaattctttatttggctgtatttttgcatctttgcctgcaaacttccacaaatacatactttgcacagttatcaggctgatcaaaatatcatgaaatgtggctgaaaagctcttattttttaaattatgaaatgaatttctatcaaatataaaaacaaaaaattttatacaaagtatcataatatacctttcctatgaccattgaagttttcaatgacctaatgtatatgtgcctatccatgttcatctttatcactcactgttttgcagttattttagcaatagcaaactgcattcttttctgtatgcttttgctcatgtccccacttcctgaaattatcttttaatcttgctttacttaatttctactatattctgtgtctcggatcagactagctaacagacctatcacatgctttgaaaaaaatgcctgacactatgttaaagggagaaaatttaaaaaatttatatattacatcttatcttttcattaggtacattcatagctaagccatgccttaagataatactaataccaattagaaatagtctattgaggatttttatatatctgaacccatgttcaggattttataggtatagccattaaactcaaaacagactgtggcagacatatcactattatccaccggaggccatccttaatatgcctctctgataaaagacatagattagatttcctcagagggtaaaattaagatgtacagagtttaggttacttgtaggacatcatataactaagtggtggatctaggagttcaccccacatgtttctgacttccaacattatacttcataacactgtggtgtaacttctctcaatgaaataactatgtctgtctgtctgtctgtctatctaatctatctatctatctatctatctatctatctatctatctatctatctgtttctgtcctcatgagtatttaaatgctggcttgacatctaaaacaaattagatagtagacaacactaaacagtaacattttggaaaacatacctggagtaatttaccctctccctacattcaaatttaaatattcatgaaaacacagaaaaacttatgagttgtttaaagtagaatggaaactaagcttagtggtctataatatgccaaacattcataagctcagtatgactctattaccaaccatagcaccctcctcttttacccacctacaataaacaaaagaagtcaacattcttcacgtctaattaacacattttccccatagtactctggaaagtgaggcatggatgcatgattcatggagggtgaattattttagtcatttaaggtgctttgtggctagaaggatggaaaaaggggatacaagtgctataagtggatcacttaaagagataatctatctctgtgggaagcctgtacagaatgagacactctctagcccaagggcaataactggcttctggagcaagatgctggctattgaacgtgacaaggaactgcttatggctcctcctgaccaaggctgtttctgtacctgagtccttcaggagataggaaagaaaactagccaggaaggtaaatgaagctgcttttaaataacaattctatgaaaacaaaacaaaacaacaacaaaaaaacaaaaacagagatggttgcatttacttccaagacaatatattttatatctacattaagcagaatagggtttgtgacttaagttgttatacaaaaatgacagttacatttacttttgaaaatctgtgtttgtgattatgaaacttgagtctatcaaaaaggagaatatttcctgccaccctatcagttactcccttcctcagtggtttaggggcttctgtgggcatttcaagcccttatcaatgtccaatattcctttcttcccaggtgcatggaacagtggcacttttcttttgtcttgaagttgtagccattaaactgcactggccagtcaaatgtgagtaggtgatatgaatcactttcaggaaacatttaattgccagactgcaactctcctgtgttctcttctccagcccaaaggctgccttaagcttttgaggtcacaggtttttaccatatcattacttagcctaacccaagtgaaccaaatgaacgaaccaaatgaaccaaatgaatgaatgaaaactgctttctttctagctggaactctttccaacatgatcccaaattagacaaagcaccttctaaagctatttatgtaccatcatttccataattaaaacaggtataggacaaacatgggtagatggtagaatttgctgtcatagacataaagggaaccagagaaaaggcattgaaagacattgtgatcagtaaatgctaagtgttgtgccttttcactctctaattacataaagggagtaatttacagactgcttcacattacccaaaatatctgtcccgcagtcaattgaacataaattttcaagaataagtccctcctcacatgaaccacagcaggaaataaaaagcagtaagaggaattagactagctgatttgaggaccaaaataccatccatttaatattagagagttcaacaacaaaaacataatatactttatgtttatatgaagaactgcatgtttaggttattcaagaaataggaaaagcagacaacaaaaaagaatgggcaactgaaagaatttccaaggaagaatctgacataaaaaagaattaaatatgttattaatgccctaggcactgatagatgtcctagagatagagctatgactagcaataccagatttgtttttattacatgaaaaatattttgaggaggctgtggaatgtggtgaattattacatctagaggcagaaggaggcaaaacaatgacataaaaaggaaggcaaaacttgaaccagatacttacagacaataactacaagagataaataaaactgatagtacgaggaagaatggggaaggattgtggttgttggtgatttagagtcagaaggctgggaaggtctctctagaagaagaaagttaactgagattcaaatgatatgaataatccagtgttttgaggttttggtctctgaggtgagatcacgttggcagcatttgaggtgtagaaagtattctagtgaaactgaagtgttctgagcctgagaagaattgtatgaaatgatgtaggagatgtgggctgggcctttttgtgacagatgctggtagtcacatgatgagggcctagttaggcttcatttagaaaatgcatccgaattatgaactactatccaaatacatttaaaatattctggtgtattttgtaaagttaaatacttctcttgttaattatgtctgtttagataggtcttgttaatgagacaagaaacacctgtgtttggcttgccatgaagaattatactggctgttttgacctctggaggaaggctgagccctttggcatcacatgtgtttgcagctcgtcaagctggctggatatcccacctctccatgccctatagctctgtctcggaacctgtgattgctgtgaattgtgtcatctgcacacagttcactaaccagttatgtatagactggttatgctacatttagtagtttgtgttttattctgacagttggaaagccacaagagagttttaagttggggagtaacaaataaatctataatttaatgggactaccatgcctgctttgtgacaaatggatcactagaaggcagaaattgtagtggggtgaccagtttgaaggatgttgaaatgactgcaaataaacaagtttcacaggttctttaaggaaaaaaaaaaaaagaaatagctgacaattctatgcccaatcaagttgtcattgagataaagttaacagaatgtttgttaatatataaaatgtttaaattaaatgttaaatatattaaataaaatctattgtaaaaataaagctctatgttaaagcaaaaggaataatggaaatggaatgaggggagaaaacataccaaataaatcaagtaaaatatcaatagttaagtttttctcttttcaattattatttctagaagaactagtttatgtattacttttatacacttaaagcttctagttaagaaattgctgctctaagacttgagcctctgccagtgaatgctactgtagcacataaggcttaggaagtgggcagcatgcttgggaataccattatcttagagacatttgcaaaagttcaaaactaaacatgtgtaagttacttccagtaaaagtcatcatcttataccaaggcacaaggagctaccacgtctaaaccttaacacaaagagaaacagcaatagaactggtgactgcagggtttcagaaaccaacaaaaccaatcatattatgattcaaatataggtaaacttgagtcattatcagatgttcaagcactgatggtcatcattcacccagatatacattctactcaatctagtattcccaagcacttttagggtcctccactggggtttgccacactctggtaaaaagaatcccatttttaaaatttcttagcctttttatcttttttttttttttgcctaaatcagttgttctcaaccctgaattcacataatattgaatcattctttgatattaaaaacaaacaaaaatagctaggcatggtggtatacacctgtggttccagctacttgggaggctgaggtgggagaatcacttgagcctggaaggtagtggctgagctgtaattgtgacactgcattccagcctgggtgacagaacaagaccctggctcaaaaagcaaacaaagcctgtaattctagcactttgggaggccgaggtgggcggatcacgaggtcaggagatcgagaccatcctggctaagaccgtgaaacctaccccccctccccgtctctactaaaaatacaaaaaattagccgccgggcggggtggcgggcgcctgtagtcccagctactcaggaggctgaggcaggagaatggcgcaaaaccggcaggcagagcttgcagtgagccgagatcgcgccgctgcactccagcctgggtgacagagcgagactccgtctcaaaaaaaaaaaaaaacaaaaacaaatttaaaaaaaaccccaaccaaccaaactaaaaacacaacactcacagaaaacaagcaaggaaacaaacaaatgaaaatctacctcttccccatatgaagatgggtttaaatcagaaaacatactttaaaacaacacctttttttaaaatagttttcttcagaaaacaagcttcctctgcggccttcttaaggctcttctcttacacatcacatatgtcagagacaaggactgacatggctcattatcaatgcttccagacattactctttttctttaaataagcaaaaaaaaaaaaaaaaaaaaaaaatctttggttcctttaagatatatattgtctttccataccagtgtgtcacacactttaatgcaaaccatgtggagtttgtattaaaatgcagtgcagactatgattcagtaagattggaatagacaagattctgcacttctaaaacctcagagggactccagtgctgctggtccatggaatacacctaaaaagcacaagccaatatcatcctctctttctgtgaatcacctcttcgccctcccattcttttgctcaattttagcctctcgttcacagacttttcttccccatctccttttatcaatcccaatgatataaacatctatatagatgaaataatctcaacctgaacatttttatattaataatctaacattcaatgatgtttccctctacttcaccttaacacttgtaccttatcaacaagaaacaagactacatttatatgtctattttaaatatctggttttcatcttccgttctgctgcaccatcctatgtcccatattcttacagttctcctgatattgtacattcattgccatcatttcctgaattcattatgtccctgagcattttgactctactactttctcagaagggcccttcttgtcattcttggtggggagcagaggcacatgagaatcctattctttctggtatctgcatgagcagtcagcccactaaccactgagcaattcgtttcatgtgaatcttgtcagtggccaagacacttgtgcacattgatcttgactgacccaaaagagtatacaccaagtaagggaacagtcttctctgtttagagatggggatgaaacttatacagttgaaaaaggagacaaaggaagagaacaaatggggaacatttgagtctctattttcattaagatggaattaggcatcagattatctaagtttccagccttatttcatcaaatcctaattctggtactaggctaattattactaaattttcatgtggtgtgctttgctaatcacttcttgtgttttcatgagtgtcttattggaaatttgtgaaaaaacatgtcaatcctatcaggacatgattttaaggtagaagctaaaaaataattcagaatattttggggggagtgagtgattagagaacatgtataatggagaatgatcagctctggagcatgtttactttagcagtgaatggcctaatctacaattacttgcatgtttcttagaacattttcttctctctgtattctactactctacagtgatacgtgtataataaattgccatagtgatttggaattttaaagcaattcaggttaggctatagtatctcaaagcccctaggtaaaatttaaagcagaacacaatttacttaggttattttcattttctgcttagtctcacctttacttatttcttattattagtcttcctgtttgtttcatatagctaatttatttttgtttgcaacctgaaaaaaaagaacactaaaactaaatttggaaaaaaagtcataaaatttcttatatcatgccttatgcctaatatatttaaaatgacttaagagaaaatagccacctatgtcttttagataatttgtaaaataaactttcatatgaggtgtaatggaagaggtctcatattgaatcttgaattgggacagatattaaaatatcagaatcccaaaaaattgttttaacaagtaaaacattaaataaagtacagaataacatatgcacagaaatgaatatactaaaaaagcaggtttttcaaatgtagtccagaataacttggctttcacaatatcacaaaaaggggatttgccacaccagaagaaaccattcatacatatcaccccacttgttttttcctaataataatgtttataattcagacaggtcttcaaagacagggacctaattgggcttatgcactggattggtagacataataaggtgaaagttatgaagagcgtgtcaatgagaaaatttgatagtcttgaaacgtaacatattaatttgcagtcttatctcagcaaaacaagtaactatcttattttttgaaattcgtactgtttatcataggaaaaaaaagtgtggtcccattaatgtttaacataggaaattatgttagtttcagttttcacacaccactgaactgtcttttgatgccatagtttgaaattataaaatgtggaataattaaacatttattgaagttataaaaagtgagaaaaaatataatttttgagtcaagttttcacaaactaaaactattttctgttttactcttaaatctgagtaaatcatctaaaatcttaaaatatcaattttagaaataaaatgaaaataataccttgtttgaaaatttaacaatgattatgtgagaaataatgcaacaacacgttgagttcagtgcctggcatagatatacatctatccatttattcagtaatatttgaacatagatattatgagcatatattaatatgaagacacaattagtcgtgatttctaaaaaaataaatacagataaaaatgatttttatgagtacttgcagctatgctatgtctatttaacttaaatataaagctcatataaataaagggaaacttgagcaactgtaattttaaattccaaagagacttcttgactaattgctacgtaaacatcctttcttcgactggggaaaaagtgaatgtacaaacattaaaaaaatttgttcaccctaatgttgtatcctaatacaaagcttgagctattatttttctaaagagatagttaaaaataaattacaaaagaggaagaatgaaagcataatgtattctgtaatacagttatgttttattttgtgttaaatttattttttgctgcttttaatataccttattagaaaatagaggaagtcacctcacattgccataaatgagaaaaagttgtaattaaatataattaattgaattaagttgcgtatatggacagaatatataaggacacttccccttccaccaggaaagcaaagaaataaaaggtcctttgaacagagcttgaccttctaagacagtttgtgataggaattcactgctcaaacctatgaaataattgcaattgaggaaggaaacaatacaagagcagaaggttgacaaaccagagtggctaatatatgtttattacttaatgttatgtcttttcaaaagtgaaagcagctttggtgaaaaacttccaattggtggctatttcttggctttcttaatctttcaccagctgacttataacacccacccacccacacacacacacacacacacacacacactagtttagtctcccaaagagaaaagtttatcatatttcgccaagaatttccctaaattctgaaatggtgaaaacagtcactttatcagaaggatgttcataatgttaaattaacatttaaagcaagccaggcctgtaatcccagcactttgggaggccaaggcaagcagatcccttgagctcaggagttcaagatcagcctgggcatcatggtgaaatctctacgaaacagacaaaaattggcagggctggtggcatgcacctgtggtcccagctacttgggaagctgaggtaggcggatcccttgagcctaggagtccaggctgcaatcagcctagattgtaccactgtactccagcctcagttacaaagtgagacactgtctcaaaaataaaaatataaaggaataaataaatgtaaaaaaaaacattgaaagcaaaagggactttgtagacctcctacacatggatacaaataagaatttatcattgagcttgatgttcgctttgtcacattgagaaaatttaaatattatttccagatgaataaatttgttgcattaaatgtcaatggtacactgaagcgagaatgtgatttgaactcaagagtctttagaaatttgtatcaaaagataatgtacatgcttaatttttatatgtaattcacaaattataaaatataatttgtcagaataaaaaatggagttttgtacttacatttgaggttttataattttattacaacttaaacatctccatgtctaatgaacaatatatgcattacttctcctgactacatcaatctgcattaaatcatagtgacagttgcattaaatcatagtgactgttacattaacagctaaatgcagatagttctcttcatttaggaacatgcttgttaatcagaattacacaaatcttgtacatctccagaaactaacactgacctagaacttaattgttcatctaaatgctctgtgaagtgtttgaataggtgtaatttatttacttagaaattaccaacacagatgctgtcccccattacacacctcttttgtattcaactatgatttaatggtttcttgtacaaaactagtccaagccaattaaaaagcaaataaatagtcacagtggagggtaaattgccttttctgccttcttgaagcatgtgtgcaccactaagataagatgttgtcaatctgttaaaatctccgtgaatccatccttcttcactgctagtagcaggaaagctttaacactttgaacaactaggaagggtcatttgtctaagttgtggcaaagcctaaggggcagaaaggccatagtatttcctgcaacacattaatctagactttaaaataatggaaaatattccaaaagtgtcactgttaaacacactgttgttggcttaattcaacttcctttttcccttcatttattcaagataaaataatgctgtacattttatttacaaacatgaagcaaagccaatgtcattaggattgttcagtgtagacaattcatctatagagtctcaatgaaaccagttgctaagcccccatctcaagtaacttaatgctgtcacttcctcatcaattcctttgtcccccgctgcccatttgcagttgtttagaattttgtttctgttgcctagaacaataatgagtattatgatgaagttatcaatgacagaaatttttaagcacattaattatgcagttctatttcaatgttaccaatgttcttttgataatatatgtctattatttctattttgaattgcatttattatagactaaagctgttgtaataaagaatccgaccaaaatttttgatgtttgatggcttacagcttctacatctcactcctccttgctctcctactccctcacatctataaaaagtggataagaaagtctgtgtgcttcctactttggcacaggtcagaagctcaaaccatgtaaaccccttcccctcctggccccacctcctaacaataaggatccaaagacaatctcccttcccttgcttttaggccaatttaggaggcctgccttcctctcttcagaaaagccccattatgtgagtaacaaaactttttgtgcgctcttggggtatgtgtggctttatcagtctctacatctgaaccaaactgtgggtaggaatctagcctgcatcttctggttgtatacaatggttttataatttacgtatgcatatgaagtacctggtaagattataaagcatagattcctaaaccttctgcaagtttgtgaattggacactctagtgagacaccaacaagtcagggttttgtttctttttgttgtttgttttttacagatttgtggcatcaacattttaccttttatacccatttcttggataaacttattaactctttcatttaaagtcttgctttaccttgtgcattattctcccactcttctttaaggcttaaatctttgtatcttcaatgacaataagactttagcacacgaatgtgctcaatgttacttctatctcagaactaatcaagtaaaacttgagaaatatcagcaacaataataaatagaaatgtcatcatggtttcttatgtcaatgctaactctaaatttgacaaatttctggtttctagcttgatttagagatggatcctaaataggctgcttgaattttccatcacgtctaattctttgttgcatgtagtttttaagtgccagttaataggcaagcacctgcctgaccacatcagcaacaccagaggcagaaggcattattaaaacacagatttttgggcccactccacagataagttggtgtagggcccacaaaaacgatttttaaagaagcaccccttcaggattcttatgcagtcagctaagtataggaatactagttagtaatgaatgtgttctggagcctcaaaatattttagagcaggaagctgccacttattgtgccaagttttctctccaactcttgcagcccagcatgtcaactgatgaaaaagtgctggcgttccaaaaagcctgggggatggtgctcagaaagcccctgctaggagctagattggattatctcaactcatacctctcagctaacaggtgacaccctgctgaaagctgttgacctgaggctcttttggattgtggtaagagtgtgaattgtgatccatcactctggagaaccctgatcagaggctattagcaatgcacctggtcttggcaattgatagaaaaaggaacactgtgccaggggaagcttgcgacaatgaaaactgtttcaaaattcttctttatatcagcaatcctaactctagaatcatcaaaatataactaggttttattgtgtgtgaaaatgtgataattccaatcaacacagttgtactacttaaatccttcagttagaagaaaaatactaaaaaaatactaaataaacgaacagatttttatgaattttatactgtaatttcccttacacctagtagggaagaatatttgaatttctagaaataatgtatgtatttatctacatataaaaataaaattaagactttacataacacccacctttaatcaacgtaacattttctgacatttatgcattttcagaaaagaaacaactagcctgcaaagcaattgttaaattttaaatgtaggcctccaaaatacaataaacaaactacagaaaacagaagcctatcaacacagtaaacatttgcaatggttttaatataaccataattataaactgaagaacagaaatatattaatggaaaaacaatttactgtagctgtgttattgtcctgaaacaggaagcctatgtatctaataataaggtggaattgcatcatgtgtaaatatataaaatgagactttttcaggcaggcattgaacacatgtttactcagacttttaatgaggtgtctgagagaatagcagtggtcccttcagtatccatttcttcattttcttaggcatatcatctcccaaatgaagagccagggtgatgggctaagacctcatatattaaatatgtacagaaaaaaatgtgtgtgcaactttcctctcactgtttgtgcagaactttctctattttatcttcctataaattgcttgtacaatactttattttatcttcctataagcaaaaacacagacagacatctagttttaatcaatcaaataataataataacttacatgatgaaagatcccaaaatggaagcaattgtctttctgaatgactttttggtaagtaaatctggtcttccagtaagaacttcccatggtcaaactattaagagatgaataaatatttatcttacccaaatcattacatttttgggtctaatttttacagcagcttaacctttaccatatccgatcaaggtagaaaaagaaaaatattcaaagttatatttacagagaaatctaaaataaatattaacagaaaggagaagtgagagattgagaagcaaaaccaaggatacccattgtcactacacctattcaatatagtattgaaaatcctagctagaacaatcaggcaagtgaagttaataaaaggcatcacaataagaaaagaacttgaactatctttcttcaatgacaatacgattttatacctagataacactaaaagactctgccaaaaagctcctagaactgatagacaacttcagtaaagtttcacagtacaaaatcagtgtacaaaaatcagtagcatttccatacacaaataaagtttaagctgagtcaaatcaagaatgcaattctatttacattagctaaaaagaataaaataagcaggaatacagctaaccaaggaagagaaagagctcttcaaggagaactacaaaatactcctgagagattacacaaataaatggagaaacatcccatggtcatggatcaaaagaatcaatattactaagatggctgaactgcccaaagcaatgtacagattcagcattatttctaccatactaacaacttgatttttcacagaatcagaagaaactattctgaaattcatatggaacaatagaagagcctgaatggcccaagcaatcctaagcaaaaagaacaatgctggaaatttcacattacccaacctcagactatgctacaaggctgcagtaaaaaaaaccagcatggaactggtacaatagacacatagaccaatggaacagaataaagagatcagattaagtcatacagctacaaccatttcatctttgacaaattttacaaaaataatcaatgaggagaagactccatattcaataaatggtgggtgctgagataactggctatccatatgcagaagagtgaagttggaccccctatctatcaccatatacaaatatcaattaaagatggattaaataaagacttaaatgtaagacctcaaactataaatatcctagaaagaaacctaggaaatatccttttcaatattggtcttggcaaagtatttatggctaaatccttaaacgcaactgcaacaacaacaaaaattgacaagtgaaacctaattaaactaaggaggtcctacacaacaagagacattctcaatagaataaatagacaacctacagaatggggaaaatatttgcaaactatgcatttaatgaaggtccagaatctataagaaatttgaagaaaacaaaaggcaaaaatcaaataaccccattaaaaaatggtcaaaggacatgaacagacacttctcaaaacaagacagactagtagccaacaaacataaaaaaaatgctcataatcactaatcatcagagaaacgaatatcaaaaccacaatgagataccatctcacaccagtcggaatagctataatcagaaagtgataaaataacaggttacctctgaggctgcagaggaaataaaacacttatacatagttggtggtaatgtaaataagtcactggaggggcagtttgaagattcctcaaagaactaagaattgaactaacatttgacccaacagtcccaatactggatatacactcaacggaaaataaatcattctgccaaaaagacacatgcacctgtatgttctttgtagtgttattcacaatattaaagccatgaaattaacccagggtatatcaacagtgtactggcaaaagaaaatgtggtacatatacatcatagaatcttatatagccataaaaagaaaaaaaatcatttcatttgcagcaacatggatgtagctggaggccattatactaagtgaagtaatgaagaaacagaaaaccaaataccacatgttctcacttacaagtaggagttaaacattaagtatacatagagataaaaataggaaaaaatagacactggagcctagtagaggagggaaagagaggagggcaagggctgaaaaactaccgcttgagtactatgctcagtaccttgctgacagattcattcaaactccaaaccttagcattatgcaatatacttatgtaataaatctgcacatgtactctctgattctaaaataaaagttttaaataagttacgttcatgaaataaaattaggaataaatattagcttgcccttcccatacatatttgaaatatttaataacaatgggaaaatagtttttgaagttgtaagacaattgactgcaattaagaaaatcacaacagggaatacgatgcagtcatagaaaagatcatgtcctttgtagggacttggatggcactggaggccattatccttagcaaagtaacacaggaacagaaaaccaaatactgcatattgtcacttataagtgggagctaaataatgagaacagatggacttatagaagggatcaacacacagggggcctatcagagggtagagggtaggaggagtgagaggatcaggaaaatgactatttggtactaagcttaatacctaggtgataaaatagtctgtacaacaaacccctatgacacaagcttacctgtggaacaaacggcacatgtaccctggaactaaagttaaaaaaaaaaaaagaaaaagtacatccccataaagactaaaaaaaaataattaataagttgtttttaaaaatagttttaaaatatgctaaaaaaactgtttattgtaagtggtaaaaatgcaattaactaactcaataagaaagaaaaaatacattgacagaaataaactatttgggacataaatgatgaaagacaaatttatttcttaagtttttataaattatatatacatataaactttataaaaaatatatatttggagtacaacatgttttggcatatacatacccagtaaatgattaatactgtcaagctaattaacatattaatcacctctcttagttacctttgtgtgtgtgtgtgatgagaagttagttttattggagaacaaagtagtcatttcccttgagcttagataagtcaataaaactataaagtaagtaagggggaaagccagaaacaacagaatatacattcttcttattgccacatggcacatactctaaaattaaccacataatcagatataaaacaatcatcagcaaatgcagaagaactgaaatcataccaaagacaatctcagatcacagcacaataaaaaatgaaagtcaagattataaaaaaatcactcaaaactgtgcaattacatgaaaattaaacaatatgctcctgaatgagttttgagtaaataatgaaattaaggcagaaatcacgaagttctttgaaactaatgagaacaaagatacaacacgtcagaatctctgttacatagctacaaggtagtgagggaaatttatagcactaagtgctgacatcaaaatgttagatctcaaagtaactacctaacatcacaactgaaagaattagagaagcaagagcaaaccaaccccaaagctagcaaaatacaagaaataaccaaaatcagaactgaactgaaggaaatggagtcataaaacaacattcaaaagatcaacaaatccaggagttggttttttgaaaaaattaatatgataggctgctggtagactaataaagaagaaaagagaaggtccaaataaacacacttaaaaatgacaaaggagttgttaccactgaccccacagaaataaaaataactgtcagaaactaccatgaacacctctatgcacacaaactggaaaacttagaagagagggataaattcctggacacacacactaccccaagactgaagtaggaaggagttgattccctgaacagaccaataacaagctctgaaattgaatcaataataaatgccctgtcaaccaaaaaaattccagtgccagatggatttacagccaaattctaccatatgtataaggaagagctgattcctactgaaactgttcaaaatattgaggaggagggattccttcctaactcattctatgaggccagcatcattctgataccaaaacctggcagaggcacaacaacaaagaacactttaggacaatatccttgatgaacattgatgcaaaacccctcaacaaaatacttgcaaatcaaatccagcagcatatgaaaaagataatccatcataatcaagtaggcttcatctctgggatgcaaagttggttcaacatatgtaaatcaatgaatgtgattaatcatatacacaaaaataaaagcaaaccccatgtgattatctcaatagatgcataaaaggctttcaataaaattcaaaatctcttcatgttaaaaactctcaacaaactaggtattgaaggaacatacctcaaaataatgaataatctatgacaaacccacagccagcatcatactaaatggacaaaagctgtaagcattccccatgaaaaccagcacaagacaaggatgccatctcttaccgcttctattaacaacatagtattggaagtcctagctaggttaatcagacaagagaaataaataaagcgtattcaaatagaaagaatgaaattcaaactatcattgttagcagtcaacataattctatatctagataaccccatagtctcagcccaaaagttccatcagctaataaacaacctcagtgaagatttaggataaaaaaaccaacgtacgaaaatcactagcattcttacacaccaagaacagccaagctgagaggcaaatcatgaatgcaatctcattcacaattgcaacaaaaagaataaaggacctaggagtatagctaatcagggaagtgaaagatgtctataatgagaattgcaaaacactgcttaaagaaatcagagatgaaacaaatgggaaaacatttcattcttattggtaggaagaatcaatatcattaaaatggccatcctgcttcaagcaatttacagattcaatgctatttgtataaaactaccaatgacattcttcacagaactagaagaaaagtagtttacaactcatttgaaacaacaaaaaaaagtgcccacataaccaaggcaatcttaggcaaaaacaaaaacaaaaaaagcaaacaacaacaacaaaaaacaccaaacaagcaaacaacaacaaaaaaacaaagttagaggtatcatgttacccagtttcaaactatactacagggcaacagtaaataaaacattatggtactagtacagaaacagatacatagtccaatggaaaagactagggagctcatcagaaataaggctgaacacctacaaccacctgatgttctacaaagctgacaagcagtgtgaaaaggactccctattcaataattttgctgggataactagctagctatatgcaaaagattgaaactggactccttccttacaccacatacaaaaatcaacacacgatggattaaacacttaaatgtaaaacctaaaactaaaagccctggaagacaacataggcaataacattctggacacagaaacaggcaaacctttcaagatgaagacccaaaagcaattgcaacaaaagcaaaaaagagacaaatgggatctaattaaacataagagcttttgcacagcaaaagaaactatcaacagggtaaacagacaacctacagaatgggagaaaatatttgcaaactgcaactgacaaaggtctaatatctagcatctataaggaacttaaacaaatttacaagaaaaaaaaacccactaaaatggttggaaaagtttgaatacacttttcaaaagaaggcatacatgcagccaacaggcatataaaaaaatcttaatataactgaccattagagaaatgcaaatcaaaaccacaatgagataccatcatattacaccagttaggatggctattatgaaaaagtcaaaaaacaacaggtgttggcaaaaattgtggagaaaaggaaatacttatacaatgttggtggaagtgtaaattagtttaatcattgtggaaagcagtgtggtgatttctcaaacagctagaaacagaattatcatttgacccagcaatttcaaaggaacataaatcatactaccataaagacacatgcatgcaaatattaattgcagctctattcataatagcaaggacatagaatcaacctacatgcctattaatgacagattggataaagaaaatgtggtaaatatataccataaaataccagatagccttaaaaaaataatgagatcatgtcctttgcagggacatggatacagctggaggccatcatccttagcaaactagcgcaggaacagaaaaccaaataccacatgttctcacttataaggggaagccaaatgatgagaactcttggccgcaaagaggaagacggaaacaacagacactacagcctccttgagggcggggtgtgggatggggagaggatcagaaaaagtaactattgggtactaggctcagtacctgggtgacaatctgtaaaacaaacctctatgacatgagtttacctatataacaaacctgtatgtgtgcccctgaatctaaaataaaaagagagggaaagatcaatttatcattaaaactgagatacattttaggaatggcaaattacattgtggggccagagtaccccatacatatcataatattttgggtcagggattatataagaataatggacaagatcttgggatactcttgcaactgtccagacctagaaaaaatgggaagttgttgagaaaatctgtgatcatatgagtgagtgataggagatttgtaagtttggaaactgatatatatatattttttcagattagagatgatttaggttggaactcttgcagtggctatagaggttgaatggtgagtgatgacacacttcagtaatttagactcataatgtctattgatgtcttattttggaaaattgatttgattcctagggaaataatagagaaaatctatttcaactatgggtgagatgctttaggttattttgtttgcaacggttggaagagtaaaataaatcacatcacctttttaattcttagaatatttagtcagttacattccctatgttatcctcaaccaaaaagttaacttttccaaagacaaattcattttatgaagttgtgttactttttattgaaaaaaaattaatgtcactgaaattttttttcattctacctcttatttaatatgcaaaaacttgttagtaattgagatagaagacctgtagtttaaatgttgtattattcctgatggatgattatgaatataggacttgactatatttcaagtttatagtttataaagaatgtagtttcagtggatttaaaatagatataaatatagattaaaaaattatttatagatggtttagcatgaaagttttctgctaaacacttacaagtctgttaaatatcacttcagttaacagtgaaatagtgaatctcattcatttttttttaaatctaaaatcagattccatctgtccaatttggtattttggcactaactgttatttgtgatttcgtttgatatggttcatctggaattttagtagtgaccattcattgtgatttgatttgattatacatagctctctgtgatgcttactggaacgcagctttataaatgcaaattgtcctgtatgtctcagttactctaaaattggatttaactatttggaaattgtgggccaagagaagcttcatgaacttcttttaaaaattctgtaaaacatggtatatagcaaatctatttttgaatcttttacatgtaaatttaatggaaacattaactttcatggcagaaataaatatgtatatatgattctaaatgattcattcatcaatatcagaattaaataataaagacaaataaaaaaattcctgtcaatgtggccttctccttgaattataagtcaaatgtattccatacagtacattgaagaatttgtacctatgttaacacaaaagtttgatccatagcatattcttcatgaataaaagaagtaagccatagagggatatgtgtaaattggatacatataaaagtattaggcaatataaattaatagtaaaatatgatcaaatttgaataaactttcttgaaaataacaaattttcaagcaggaataagtaagttatattttataatttccaaggtcattatagtacaaatcatattacgatcacttttttatagttagaattatttctaataggactatctgagctacttcgagaaaactagcaaggtctaccctgaaaacacttcagatatgtgatatttcaacatgtaataatatttataatacatatgtcagatcttaggtgatagactatttactaacataacaattaaaaacaaattacaaactgaatttctaacataaataatgaagattaaatatcctatgcactcacacatatattatcaaaacagtatgttactagacaaaaaaatatcacaaaattataatttttcttcctttttcgagacaggatctcatactatcaaccaggctggagtgcagtggcatggtctcagcttactgcaacctctgcctctggtgctcaggagatcctcccacctcagtctcttaagtgggaccacatgtgcacaccaccacacctggctaatttttgtattttttgtagagatgaggttttgtcatgttggccagcctggtgtcaaagtcctgggctgaagcaatctgcccacctcggccttccaaagtgctgggattacaggtgtgagccactgcacccagccaatttatttcttttttaattcaaaaacttttatattgagtactaaatgtatgcaacacattgtgcagatattcgagatacacagatgaacacaatcaaatgtcttctgacctctaaccttatagaagagtccagataagaaagtaaacatccagcaaataatcaccccaatgtataagtaaataaaactgacaaaaataaaaaaggatagctatatggttccaggaaaccccaatagagaaattcactctagtttctctgaggaagtaaagatttagttatgaaacagcattataaagcaattagcaggatcagagaagaagcagtgcggaaagaccattccaatcagaaacagccaaatgttaaaaggccctcaggagtttggcatcgtgaagaaatgagaccatttgaggtcaggttgagaggtaagactgtacccagactgtgggccatgataaagactgaccacttgatattaaggcaatagaaaagcactggagacttttaagccagagatggaatggagaatcagggagaagatcagatttgtagactggaaaattttgacttcagtatacaaaaagaagtatctgaggaaaagagaggtctggggaaagcaggaagccactaaattagctcatgtgagtgataatggctgctggatataaggagatggaaagaaaggcagagaagtaggtagaatcaataaatatttaagaggttaaaatatataggattagtactggaatgggtggcatttgtgtattgaaagagaggaaggaatacaagagatatttaagaggaacaagtttacaaaactaaaccatatgtttggttataaatatgttgaatctcaattatatttatgatatttacttggaaaacataagtaaacatttacatactaaggtatgggcttcagtgagataaaattttgtgtttattacatattggtgataatatcacaccttgggcagaaaagagactgctagagattataatgcctaaataaaaaaagaacaaaaaattaagaaatctttaaatgtaatgttttgtacaaaaagatgaaccactgaaaaagactgagaaggacgtttttaaaatatcacctgaggccaaggacagtaccgatatcaatgaaagatttcaatgaaagagactttttcaatgagaggatttgagtcctattgaggaaaaaattaattacttaaattagggaaaatagttaatatcattagtaatcacagaaatgcaaattgaactattaagatataactgcaaattagcaacagttaaatgataatatagaatgtaactataaaatgagtatcacaatcttcacatgtctgcttcttactttttttggaagcccagtattactttaaaatgtatcatgtaatctactaccagcgatatttggaacacagtagtaaaaataagaattattaaaatatattaagagtgtatatttggttccacgctgaaatggaaaaatgcatttattcctattatttctgctaataatggctaacaatcctggacattatttgtaaaacaaacagaaaactgaaagttggagggaagaagcaagactagctagtaatcctaggatccgagaaataacatattggtgagcacactgggttttctttatactttatatatcccagatcataagtgcttagaaaaataccttgaactaccaacaagagttcagataaaaatagcacccccaaatgcctgctttaaccaaacaaaagcaatgttgcaagacagaaaacgttaaaataactgacctgctctagccaaacatcatgaaaaattacattcatgaggccaacaagcatatgaaaaatattcaacatcactaatcgttagagaagtgcaaatcaaaaccacaatgagataccatttcacaccagtcagaatagctattggaaagtccaaagataacagactctgccgaagttgtggagaaaagtgaatgcttatgcactgctagtgggaatgtaaactagttcagccattgtggaaagcattctggagatttctcaaagaacttaaaacagaattaccatttaacccagaaatcccatcactgatatacccaaatgaaatataaattattttaccataaagactcatgcacacatatgttcatcgcagcactattcacaatagtaaaggcaaggaatcaacctagatgcccatcaatggtagactagataaagaaaatgtggtacacatacaccatggaatactatgcagccataaaaaaagaatgagatcacatcctttgaaacaacatggatggaactgaaggccgttatcctaagcaaactaatacaggaacagaaaaccaaataccatctgttattgcttgtaagtggaatctaaacagtgagtacctatagacacaaagaagggaacaacagacaccaggagcctatttgagggtgaagggaaggaagagggtaacaatcaaaaacctactcatggggtagtatgcttattacctgggtgaaaaaataatctgtataccaaacctccacagcatgcaattcatttctataacagacctgcccacgtagccctgaacctaaaataaacatttaaacaaatacagacccgctcccaccctcatcttcaaatgttgagtgggaaactagacttctacccatgcccattggaaatgatgcactcctcccgttcttagccagagaggtgtcagcagaggcccagtgaaaagcccaatatcccactttcactgctagtaggaatgtaaactagtttggccattgtggaaagcattctggaggtttctcaaataacttaaaacagaagtgacgaggtatgtcaaaagatgccatttggggaatctggaccttgacccctacctggagctactgactcaggactcacttcccccaccagcagtgtcagaggatgccagctaaaaagatgattttttaaaatatccagaatctcataatactatatctaaaatgtccaggatagaaaacttatgttttccaagtaaatatcaccacgaaggcaattaataaatgacaataccaaaatgtgacagattttgtaatgatctgaaaagaattttcaagctgtcattataaaaatccttcaacgagcaattataaaggtgtttgaaaaaataaaaaattagaaagtctcagcaaagaaatataagatattaagaagaatgaaatgcaattttagaaataaaaacataagtaaaatgtatttttctattttcaagttcacaggagaatggaaaaggcagaggaaagaattggtgaacttgaaaatacaaaaataaaatttgttaaaatgaataatagaaaataaactgaaaaaaaaatcatgaactgaacttcagggacctgtgggactataacaacagtttataagatgtaactttgtgtcatcagagtcccagaggaaaggagaaacttgagggggaagtttaaaaagtatttaaagaaataatggcagaaaatgtaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattgacaagaagaaaacaaacaaccccatcaaaaagtgggcaaaggatatgaacagacacatctcaaaagaagacatttatgcagccaaaagacacgtgaaaaaacgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatagacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccacaaaaaatgatgagttcatgtcatttgtagggacatggatgaagctggaaatcatcattctcagtaaactatcacaaggacaaaaaaccaaacaccgcatgttctcactcataggtgggaattgaacaacgagaacacatggacacaggaaggggaacatcacattctggggactgttgtggggtggcgggagcggggagggatagcattaggagatatacctaatgctaaatgacgagttaatgggtgcagcacaccagcgtggcacatgtatacatatgtaactaacctgcacattgtgcacatgtacccaaaaacttaaagtataataataaaaaaaaaacaaaatttctaaatctggcaaaagatattaacaactacagattcatgaatctgagtgtaccctaagtggataattctaaataaatccaaacacacatctattcaaactgaagtcagtgagtcagtctgtctgtctgtctgtctgtctatctatctatctatctatctatctatctatctatctagaaaggaatgaatacaaacatgttaactatatgagtaaaacaatttaattgacagcatatttctcatcagaagttcgggggcaagagtgaagtggcacaaaattttcaagggttgaaacattttctttaccccaaattctatggtcagcaatcctatctttcagaaatgaagacatttgtaggtgaagaaaaacactgagaatttgttataagcagatctactctaaaaaaatttttgaggaagtttggtaaacagaaagaaatgataaaagaatgaaccttggaaccccaagaagaaagacagtacaatatgcagagcaaacatgtgtaactccagtacactatcattaactacagtcctcatgttgtacatgattagatctttcaacttgttcattgtacatatttgctactaccatctaagatgatgggtaagttaatttgttcactatagtaattattttatagtatatacgtattttataatgtatcgtacccctcaaatatacacaagaacagttttcaaaacaatctaatatattttatttctctttagtttgaagcaaaagcttaaaattatctaatgggaatcccagtgtacaaaaaggaaatggttaagacaattacattataatcaggggaaatcaagagacttaaaaagaagttacagtttcaacacttcactcaaactggtaaaatacatcagtagatctttgttgtgatgaagtagttctgtacttgactcaggtggtggttacaggaaacatgataaatggaatagaaatacaaaacacacacacacacacacacacacacacacacacacacacagagttccaatactaatttcttgatttcataatagtactatagcagatgtaactactgggaaaagctggttaagggccacatagaatcactctgtaatatctttgcaacttcctgttactctatagttattccaaatttaaaaaaaaaaaactaataaaggacattagttatagggagctcagacatagctgaaggtcctacaaagtggaggccaaggagacatactgaatatttcagaatgttgccaagctttatggtatttttcctgacttctcatctaaaactatggaggctagaagatagtggagtattttaagtgtcaaaacactttaaaaatgaagcatattgattctgagttctgaaactgcccaaaatatcttttatgaatgaagcaaattaagacattttcagataaaagaaactagcagaatcaatgtaactacttttgaaatatatgtgacaccttcttccaacatttaacatacacctgtccagaaattccatttctacatatttatccaggaggggaaaaatgtatgtttatgaaaaagactcatatataaatgctcatgataaacttgctaataacagaccaaaacagtactagtgtccacacacccgagaatgaatcatatgctgatatactcatgcaatggaatactatgtgggagtaaaactttatgacttattaggacataaaacaacatggatattccttaaaagcattatacagactgaaagatttttttttttgtaccacaggatatagtatattactgaatttatgtaaaattctataccaaacaaatctaatttgtggtggaaaagagcttcaaaacagtggtcatcaatgggatataaagggcattaaaatgtaaagaggccagaaaaaacctcctgtgatatctgtaagtatatagatttattataaccaataatattcaagttgaaaaaataaaattattcgatttagataacaaaaatattattttgggaaattaaaacacactgttgggatttgtatataaaacatttagcacaatggaattaaaacaagataaaatgatgaaaatgacaaattgagatgtaatttaaggattctatcattttctcaatttacggttttgttatcctccaagacatagcttctcttcacattgtctcacttgtcatctccattagatatatttcctctgtgctgcaactgcatcctatggattcatctaccacagtatttcctttttgcatatgtctctgttactcctctagaccagagaacgtggctcatttatctttattcttattgctatcatctggcacagaatctgcctacagcaagtagtcattaaaggatcagcaaagcaattcacaactaccaacaattaagtagaaaattcttttcttccttttttttcctattattgtacaacagtgagttcctcagtattgggttaaatgaagttcacaaatgaaaatgtccatattgcccagttaatacaaattattgaaatgggttgacacaaataacttctgaataagtaggaagttgtgtcttatctaaggaaaatcacactcctctcaatgcctgctaaacttttgtcatggaggaatataacctgagcacttcagagcttcagattttcaagagaagagacatatttcagcttttttataatatcagctcaaacttcacatcttggctaaatatctgtgtcacatatattacaattctattctagattctgatctgagatacaccactttgtgatctatgctacgtaatttcttagtctcaagtaaagagtacggaaaaagaaactatgttagaaggtattcttattgtgaattcagtaagctcacctgagcaatatttctttagactttttattcaacttagaaacttgaaggatatggttatattacctttgaatggaaaaatttaaagagagaaaacgaatttggttaaaccagtgatcagttgtaaatatctaacatctgggttcttgatccaaataatttcacagcattcgcaggaaatatttgtgcttaaaaacttaatacaaattgcaaagcaaacttttacaaaaaactcttacttttttctctgtctccatgatcataattcattgatttaaaattgaacagtatatgttccatattagaataaatttttttaaaaagggattaattcactgtgtctactcataatcacagaagaacagagttattttacccattagtttacttactttttttttttttgagatggagtctctgtcacccaggctggatggagtgcagtggtgccattttagctcactgcaacctccgcctcccaggttcaagcgattctcctgcctcagcctcccaagtaaagtagttgggattataggcatgccccatctcatttggcttgttttttgtatttttagtagagacggggtttcaccatgttggccaggctagtctcaaactcctgacctcatgtgatccacccatcttggcctcccaaagtgctgagattacaggcatgagccacagagcccatttactcaccttttgaaacacacacacaccattcttcaccttaataactacctccttttattttttattacacagaaaacaaaaataatatcccattggaaaattgttcacagattttattcacttaatatctagtccactactactaatttatttgatattaatatttaaaaaacacaaaatcgaagaatattatgaattttttcaacatatattgttactattttttctttatgccactgttttatgataataattatatataggtattttccctcacattttatgtaaagttactagtggagttatacattaaaactttacagatagttaagtttattgaagccctgtatctttaggtatttgtgtctaaaagacatatagatggttacaatgaaagatgcattattgtattttagtccaggtctgtcagactatgtaagaggaaaaaaaaaaaggatgtggaggaaagaaatgcctaattaatataagtgacaattcagggattggatgatgcttaaagagagatttcataatcaatacataatggcaatgtcatcaaacagctagaaattaaaatctgacaaatttgacaactcccaggaatctttgcaccactggtatttattcagtaatacacagtttgatcctaagatattcatcattgcttcctcgttcttgccaaaattttcaaatttatataataggagtttttctctgcaggaaaaaagacctctgattttataatgcatttcagaagaatattagtgatttataatcaacagaattggaatatatccattccatataggaatatattactgaactctaatatgactaggtttaaaaaacgtttttacattttggatactctattccattaagtataatttaatttatatttactctttatatatgtttatatcctagaattatactttaaattcaacttttctatgaattcagaatttatttcaggtatcaataggaggaaagttttgactacttttttggtcagtttccttatttttaagagtatatttaaagtaaatatagcactattttgttgagttaagcatataacataaagtaacacttgaaaaaaatactttctgatatttatttaaaagataatgatctctaagcaacgtttagcttatttgtaagaaaacatttttcccccaaggccaaagttcaaaatcacctcattaggaaagaaaataactgacataaacaatcgcaaaaacaaaaataataatgatccattgaatactaattctcttacacttagaaagaattcctaatagttcttagggcatttcaaaaggaaaaatgagaaagaagtgagaacaggatgtgaataaatcatggaaatattctcatcatggtttcctgttcttcctcaaaattaaaagaaatcaatattaatttttctatgcaccagggatgatggtaaattctttaaacacattttcttcaagtaatccttgctttcttcaagtgatggttgctacgtaattacaattgaaatctctttaattattatcctagtgttttctttttgcatgtatttggttattttgttagaaaactattggtttcttttacaaaaacaaatttgcttcaggcagacctgtcaaattttacattttcttccttttttcttattcagacaatcaagagatttgtctcaagggtaagtctaaaggaaacaggttctgaaaatacttattctttttaccatttgaagagttccatttatcagtttaatttttattaattccctaatatgaatgattcaaaaacgttgtcaaagtaagtatatgggtgtcttttttctgtgatctacaatggtgacatcatttaatgctacattatttcatgtgactcattgtcattgtgtcctgtaagctttggaatagtgcattctactttttgttgctttgtatatatttgtactttttgtatggatttcttctttgctctaaaaattacctaacagtatgttttttggtttttaaactgcatttatatttttggtaaaaattgattattaatttctacttttattagatatgactaaagatggtgacatgagcatatctaattattttaatctataaataatttactctgtagccaagcacatgacaaatatttgtaaatactctccaaacaccaaatatatgttctccatttgagggatacatgattaaatatgcacacacatgtcatctctgtataaatattaacataaataaaataaataatggaacatattttttatatttatcatttcaccagaatatttagtttataagagggatattagaattttcgatgaaaatgttgcttatcaagttagctttgcattgctaaaacttcagtatttcttccaggcagttatttgcaagatacaagttcactattattatatatttcccttacatttttcttatgattacataatgtctcatgtcatatatttaggccctttaattctaaatctaatcatatcttgatattaatgttgtcactccttcttggcccattattttaaacttttcttatactttaataaatttgtcccttctaaatagaacatagataggttttgcttctaaacaaaatacatgattacctgttatattagtctgttctcatgctgctctgaagaaatacccaagactgggtaatttataaagaaaaatagtttaattgacccacagttccgcatgactggggatgcctcaggaatcttacaagcatggtggaaggggaaacaaaaacggccttccttacaaggtggcaggacagagaagtgttagaaggggaaatggtatatgcttggaaaactatcagatctcctgagaactcactcactatcatgaggacatcatggggaaaactacccctatgagccaatcacttcccaccaggttcctcccatgacacatggggattacgggaaccacaattcaagatgagattcgggtgagcgcataggcaaaccatgtcattccacccccagcccatcccaaatctcatgttctcacatttcaaaacaaaaacatgcattctcaacagtcctcaaaggcttaactgattccagcatgaactctaaagtccaagtccaaagtctcatctgagacaaggcaagacccttctgcctatgagcctgtaaaatcaaatgcaagttagttaattccttggtacaatgggggtacaggcattgtgtaaacacacctattccaaatgggagaaactagccaaaacaaaggggctacaggccccatgcaattctgaaatccaatagaacagacattaaaccttaaagttccaaaatgatctcctttgactccatgtctcacatccagggcatactgatgcaagagataggttcccatggccttgggcagctctacttctgtggcttttcagggtaccgtgcccctcctggctgctttcatgagttggcatttagtgtctgcagtttttctgggtacatggtgtaagcctttagtgtatctactgttctgggggctggaggacagcggacctcttctgacagctccagtaggcagtgctctagtatgcactctgggtggggactctgaacccacatttcccttctgcactgttctagcagaggttctccatgaggtctccacccctgcagcaaacttcagcctggacatccaggcatttccatacaccctctgaaacctaggcagagtttcccaaacctcgcttgacttctgtgtacccacagactcaaagccacatggaagccaccaaagcttggggctttcaccctctgaagtaatggcccaagctgtaccttggccccttttagccatggttggagatgaagctgctgggatgcaaggaaccatgtcctgaggctgcacggagtggggagccctgggcccagcccaggaaacatttttcccacttaggcctccaggcatgtaatgggaagggctgctgtaaaggtctcttacgtgccctggagacattttccccattatcctggtgattaacattctgttctgttttacatatgcaaatttctgtagtaggcttgaatttctcctcagaaaatgggtttttcttttcaattgcatcatcaggctgcaaattttctaaatttttatgctctgcttcctcttgagcactttgccacttagaaatttcttccaccagatatcctaaatcatgtcttcccaagttcaaagttccacagatctctagggcaggggcaaaatgtcaccaaaatgatttgctaaggcatagcaagagttacctttgctccagctcctaagaactcatctccatctgagaccacctcagactggacttcattgtccaaatcactattagcattttggtcaaaaccattcaacatgtctctaggaagttccaaacttttccacaagtttctgtcttcttctgagccctccaaactgttccaaactctacctgttacaaagctgcttcctaagaactcaactccatctgagaccacctctggctggacttcattgtccaaatcactactagcattttggtcaaaaccattcaacatgtctctaggaagttccaaacttttccacatgtttctgtcttcttctgagccctccaaactattccaaactctacctgttacaaagctgcttccacatttttgggtatttctatagcattgccccattacctcagtacctatttattgcactagtttgttctcacactgctatgaagaaatacctgaaagactgggtaatttataaagaaaagaggtttaattgactcacagttacacatggctggggaggctcaggaaacttacaatcatggaagaagcaaaagcaaaatgtccttcttcccaaagcagcaggagagagaagtgccagcaggggaaatgccagatgtttacaaaaccatcagatctcaggagaactcactatcatgagaacagcatgggggaaccgccaccatgatccaatcacttcacactgggtccttcccatgacacatggggattatgggaactacaattcaagataagatttgggtgggagcacagccaagccatatcacctgtcattatggggggaaatagtgtgaacacttttatctggtattatttctttttatattattttatatttactctttgttttactttttttccccttttttctttttcttatttcaggaagatttatcaaggtgtagattttctggttaatttaggagttttaatactcttttcaattttatataaaagcacatatttctgatcctttatatgaagatgacttattttctaccaagatatctatgcccaattacatccacactaataagatggatattttaaaataaatcactcccctacatgtaggttatgtggttttgttatattaaccccagaataccagtatatttattttctattatgtctttccttattcaagatttcttttccttcacttacattactcattttcaaatagtctgtcattacaggagaatctatttctcatcatgtttcctttgttcttcatctgccatatattgatttgtagactttttcttattttttatcatttttaatatcactctctagagcattttgttctaataggttagtaactaataggttactagtggattatttttcctcatattctttacataaattttaaaaaattttgatttttatctcccaaatttattgtttaataatgtttaatacttattgattattaccaattctatctatttgctcccttgggtattttggtgttcctctttgtttagctaaatgctaaattaatttattttcactttttcttatttaataaatcatatgatcagggctctgaactttttcctaagtgaaactttggcagtattcacatctaatcttcaaaatgtttcttgagtttacaatatttgatagaatctgttgctgattcattatggaaaaacatagaatattatgtattttttagtatgacatttttgacaatgattacataaaataagtttatgacctatttactcaatttgatactaaaaaaaatatggaaaacatttgtagaacatcaaaatcacatgcagacattctgaaaaatgctccaagcatcagaaaaagtaatgactgtgtaattgtatcgaaaactctgaggcagagattaacatgcaggaggttattagagagggcttttagggtcttcatctgtagaagatagggaaggagagataattgggcagagggacaatttcagttctggtataatccgaagaaagtttttaactcaacctgtaggaagctttgaagctagaatggctatttaagattgtcaagatttggggaactaagtgactcattggattcaggctgcctcagaaaataaatgtgatactgctctgactaggtgattcttgaagaaaattgcatgcagaaagctgtctaacagcattccttctagtaactagaagaataagtataagccctcagtccatcacaaatagtaatagtttgattagatagtaatgttctatagcatgtttcattctaacgtgctattttgttttaaatatacaaacacatatatatgcatttaattgtactttgtttacattttcagagattagctatgtattttcagtcaacatataatacattatatttttcttatttaaaatatttggacatagtctcttaataattagattataggaagtctaatttttcaggaaaatatttccagtgttaaatttgttatttaacttatattactggttcagatatttagaattttcctcccactattttattgatattctataattttgttttgatttaatttttaacctaaatgacatttgtaaaatatgtttttattaaagagatcaatgttagtgaaaattacttaataattaaattatataagatacttgtattactaatagcaaattacttgcaaaaggccacgaaccagcataatatttcctaatgttgttcttcatagttgcacccattgcctcatgtcaccatcattgtcatagatctctccaaggtctaggacaaagaaaatgattgtgttgctaagaaataaaattgggtttgcattctgttagataattatgctggcctatgttcttctaggcaggaactgtttcatttctctccatactttacacacctagtgttatgagaggaattttgtccaccaccctaaagatcccagtgttgaagctctaacccctagtacctcaaaatgtgactttatttggaaataggactttaaagaggtgattacattaaagtgagaccacaacagttggccctaatccaattggtctttataagaagaggaactttctacaaatacagaccagggcacatgcacagaagggcaatcaggtaaagagccagaaagagggtgaccatctgcaatccaagcagagacttaagaaaaaaataaacctgccatctttgatctcagactgccagcctccagaactgtgaaaaataaatctttgctatttaagccattagtttgtggtattttgttatagcaaccctagcaaactaaggcagctagtatagtaaagagcatacttaggtcattttgagtactttacttccactttaatagttcagccatgaaataaaatatataaatatatgaatcatagataaaacaatgtaaaataaaaaatgataattttaatattattcattaaaatataaataaatattttcatggctttagattttatgtaacatacaccctgatgctgctctagcaattaattaacaatatgacttcatattgttaattaatttcatgccaataatacacaagagcacagacggcgacacttgtattagaccaaaaaaaaaaaaaagtcaaaaactgcaacttgcctcccgtgttcatgtccttgtgtaatctctaccttgaatattgacaggacctgttactggcttttaactaatgagaatatgctacataagattgtaacatccatctcgcgagattaagctcttctctgctggcattgaaaatgcaagctaccatattataagccaccatatgggaaggccatgcagcaggagctgagggtggccatgttcagttgacagcattcaggagctttcacctcaaaggatctcacagttccagtcaatatttttatgcaaggaagagcctaagcaaaggactcaattgatctgtaccggacttcttacccacagaaattcagagatcataaatgtgtgtgtgtgtgtgtgtgtgtgtgtgtgtgtgtgtgtgtgtgtgtgtgttaaccactaaatgcgtggtaatatttttgtgcagcaatagataaatattatgcctatcttcaaacattatatgacatgttttgctaaatattttagctgggtacttatttttcaccatatctacacgaaggctaattttcttctctattctagagaaaattttcttataaacgttatgctcagtgctgccatgttctttatcaatagtatcattatgatttctaatcagccttctgtattctcttgttaactgcatactgacaagtgacaagggtgatcatcagtgatattttggtataaaatctaataaacagattgaaaagcatctctctggatttctttaagcagaatatagtcatgtaaaaattctttagactgttaatgtaatcacatctttaggcatgatttgttgcactctctggctttaaaatatcattgttaagtagataagactattatggccttctcttcacaagtgacatttatattattaatagatacattattatcatctgatatcattcaaagtgcctccatttattttgcaattagctaataattgtctaacgatagttctattaatactaactacatgttatgccactcagctggtgtccatcatagattgcctttggattcacctattcatttgtaggtcttaaatccttcacaatattttaagctctcggaaaagagggctcaagtcttttgaacctcacagtgccaactcctaccacatataagtagatattttacttacatgatcatgtgattcgataattcattaccttcaagaatcttgaagcatttaaggaaatagaaaattcacgtaggtacaggtgaaaggaagaataaactgccttaaaatggacaaaagtagaaaaaatttcaaaagaaaggagcaaagaaaaggtggaaggaagaaaagaaaggagtgagaaatgaaaaaaggatgatatactgaaaaatagaaaatgtaagacaatgtattttaatagttttatacaatgaaatgcttggtgtattaaaattaatgctaaagtagattaactgtgaagaaactgctttactggataattactatgacagatccgatataaagtaattttataattatatgtttaataattttaaagatcacactctgttatttgataattattaatatatctcttctaaactgtaatggttatatgagcaaagaggaagtgagaagagcaggagaacttttaatacttaggataatctttgagtagtcccttcactaagtacatttaattacctccattaagcatacctactgcttgattactagagcagattattttttccaactgaaatattaaaaaaatggacatgagtctcagattttcagtcaggatatgtaattatactgataggaagggtaaaggtgatttattttcatatttaaattagacaagccactcaaccaaaattaatagttaataaggaattcaaccaggtcacattatcaaaaagtacaatattagttttttatattatttaaaaacaggaaaaattaaaatgccataagttaattgacaaatgggtttagaaaggaaaataagctcatataatacatcttgaaatgtggacaatggaacacaggcatgctacatttcccaagtatttaagttattacacataagcaaatgcactcaggaattttacatcattttgaatcttcagaattacagaagggtagcatgcctttgtagagaagggtggtttttatttcaggtaacattctatcagcattaccactgacaggttagtattgcctgcactttatctagattaagccttaacataactctttcatcaaagctactacactgacatgtaggtgactgattctaatggaattagatgaaaagaagacaaagaaagggctgtcgtgcccacaccaagagctttgccacccaacatgtaccattatttcctttaaagctttcaaatttgactttgaacaggtttcaccaaatacaacactgaagcaattgctattactgatcatgccagagggattagtagaattttctcctgaattatttctttccaaagggggagtttgtagattaaatgagtcttggaaacgtttgctgaaatgtatagattcattttatgactagctttctagtcactgtcttgtgggttattaaccctataaaatgaatattttgattaactgtcctcatttttaaaacatttgacatgaattgttcttggaaattttagtgacagcactcaatatgatttcctcagttatttattcaacagaaagttgtctattatgtaaaaagcattgcagtgtagataaaaattaagcaagtcaaagcattgactaagtaattacattgtgtttggagacatgttagcagtttgactctgctaaagctttggctgaatatgtccaaaggcaggaaatgccactagaaagtttccagattataaagatccttgcataacatgccaaggcatttaataaacagtgagaatacctttatatatttttaacagaagagtaacaaggaagatctgtatttcagaaaatcagccaagcttcagtctgtagattttaattgctttaacttttaacttcttttcaaagagaattaacacaagctaagttggtgacagcagcaatggtgaagggaggaaggagagataatagaaatagtcaagaaatataattaatgagacctagtgcctaattagatttgattgcataagaggaggagaaagtaaaaatagtaataagactgcttcagagactcccttggaattatagtgtattccagcaacaattaaatcctaaaaagacccagagtacttttcattcaattcctatgctgtccaatttctgggactgacagctgtcaaaattttggctcctttaaccatatcccgtattcttgtagtcttagatctttggcccagatatatgactataaattatatatcctctcatattgttcctgttcccatattttctggacttcctctttccaagtccaacttccttcagttccctttcctcctaaaatttcccactgtgctctctcagaactatattcctcagttaacaaatttgaccatataatcattgctgaatatttcaattaaattttggctgttcctgagaacaaattatcttactgctaccctctcaatttaagggaaatttcctccacattcctcagtcattaggactgtgacatgaggatggcattccacatactctactcataattatccagaccatttccctctgatattatccaaaatacccttgctctttggtacttaaacttagtcacacacacctttttattcctttctacatcatctaccaacatcttcatcagtctttccctggcctcccattctttgcttctgcttctcagtttctcatcaaagataatggaaaaatctacttggattatccctctgacaaattggcatcccagtcccttaacttaaactctagtgacattttcatctattctattttagccactcaattctaaaacaaaaaataatgaccttattcttctctagaactgctcaacctctacaaactcctacatctgttatttgactcagttctcaattttcttagcaagttactcttttaagtgttttgacttcattgactccttaaaatatctccattagagtgtcgatttcttagtttttctttaatagcacctattctattgaaatattttctattatgggtttaaatgatcttgggaaatgttaactcaactaataggcctctgtgattacgtaatctacaccactattaaaataattataacaacttggatcatacaatgtcttgatgtaaacgatacattaggtcatgttatggaaatgtttactagccattgaatattttaatcttatttagaatctctaatcaaatctatagagtttaattatttcccagatttttctatttctatacttacctaccactgacattattcttatctctgaattttaacctaagttatttgacaaggtagttaattattgcctactcagtcatagaaatcaaaattcaaacataaaaagatatttgttgtaagttttactgttcttgagatcagagaagctattacaattaatagcataaaaattactagaaaagtagaatttttagataaaagaaaaatttagttctctaaactagtctgggttagaaaaatgcatgaaaattatatagtcatgtaatttcttaaaatattatatctattttgagcaaaatatctgaaagttttctttaagaattcctttttgtttctattataaattatttaggaaaaggttatatttttatgacaggttttttccccccatattataactttaacatgttttctttgatataaaaatataaatcaagtaccattatatttatatgtcattaaggtactgttcttgagcctatatcatgtatagcgtattgtgcattattttttctggcaaccataatctagaaatgggctatagaatgaaattcattaatgctatgttatactagaaggcacagaacataaagtaaataaatcttttgtaatatcataccaaccttataaattgctttaagggaataacaatctataggggtggtagatgattttctaatcagatattacacaatatacatcaaatattctcattctgtagtatttaaaataagcagttgtctacaacatacaatcaccagtcacaataaactattcatgcttttgtagacccccaatttgataactgcataaaacaaccaaatattttagaagaagaaatattataaggaatgtatatccaagcttctgtggttcgaccaggagctattgcctgaactacacctccttagttggactgaacaattatggaatgtgtcaaaataggcctaataatttatctcaaaaattaattaataatcaatgataaagctaaagagttttaaaattaatgcccagtaacattcttttacaatgtgaaacaaatgtaattcttatgtcatagtcatattcttagatgccatgtcttggctcactagtgttttaggccctttgcaaagaaatatgtttgtgttgataacagaaagtcaacatttgtagataatttcctttttaaaattagttgactaaacttgtcttagtttagttcaaatatgctttatttggtggcagagaaaaaggacagggtttaaaaacaaggaaattattcataacctgggtatctctaaatgaaagtattgtaatttcaaagacatatgtttcaaaattttattccagttaaaataaaactgtattatggtaagtcctatttaaaattgtaattttatttcagcacaaaagatatacacccatagataatgcaacactttctgcctttatgaatttgcactgcggaatcatttctaatagaaacaattccaaactattccaaaaatgcaagttctatgaagcattctgagtcccaaccaagcatgcaaccaacaaacttttagcattgcactgagagggtttttttaaatattgctatttttttgtttgtatttttaatagtgagaacatgccacaatattcctggaaaaattctgagcttcccttcttatcttgctcttttgggatctgtcttttatgttggaaatctgtctaaaacaacacataatttttgcccctctattcaagtttaagtataacagattaagaagccaattggaagaactctacatctgggcacaatgcattaattattgagatccattatagatagcttgtatagccaatattcttattacatgtgaacttctactggccaactctgtagaccccttctggttctatcatccagtgacctggcagtgggcattctaaacgttaatgtagaaagagtgctctaggtatgtcatactacctaatacttccgttttatctcctttgtgtttgcatttaataggccaatgacattttggcttaatttttgtatctattgtcttttatatgggtcagggagggacatcttttagactgtacaaagtcaggaggcccacagaatttaaatgtttttttgagcacacgttcaaaatagctcttcgttttcagttaccagtaacctctatcaattaccaagcttttcctgagttttcccagataagtcaaattacttcccattaatatctacttccgtaggttcttaattctgacctctctcagcactgctaagtcacttaacaactctccatctactctatactcactcatattaagttttggtattgtagatatcctggttttgtcaaagacagaattgtgtttcttttccttactttgtagctttgaaagaaaaaatggtgtaaatgtcattactccactatcatgaaatttgaaacaattagaaataacagttggagagagagaagagagggatgtaagtgtcattactgcataattttgaaatgaacaattagaaatgagagtaacgaagagtcaaagttttaacttcaaggtgattgatgggacatgggaaatgagttacaatgggacgtctagaatatttcccaccactgttaatatttctgccacaatttgattttttgtgccaaaatttttctcatatttgttgctctatatgtttttaaaaatcagtacagcgttttttttgtttgttttcttttgttttttaacctcagcatttatgaaagctaactatggtctactggatgtaaaatttggagagctgggtttgagttccaaggttgttattctctggtcatgtaactttcagtttttaacttttcctttctttatctcagttccagattactggtataggaaatgtattagagagacatttttaaatgtcctctctaaaatagtgactgttttgaatactttgcatattgtttttaattcttcatgaaacctttaatgtaactgctatattctattggttttgaccaaattatctgagacataacttacccaaggccataaagctatacaattatagatgaatatactgataaccttcaaattttcaaagttgggggcacttatcttttgtttgactacttggcattgttggcaaccaccccattgaattttatggccctaattcttggccatttcttctccacactttttgtagatgtctctgatgtttatccttatatttcaatattttccaagctctttactcagcctttcgttcatcccacgttaaagatggcatttgaataaattttttattttcccttaaaaattatatttccttaaaaattctagccaagaattctctgatatgcacaagatttgtatatgtaaattccatatacctgtggatatcacgagaaattcaaaccaaatgtctctataattatatttattatattttcccccaaaactacctatcctgttcctggttcccaatttactatttactgacatctgaggcctcaatttttggtctcattcatctatttatattcttatatctccctaccttctatctcttctcatctacactctttttctacatctacactgatttttctaagccacaaagttttcatggtataacctacttaaaatctatgtcttgacacaaattttggtgtatattttatactctttagattatcatgtaagtcttttcattttatcttcagtaagcaataaggagttggctactgcttaactttctggtcacttcctatgattcccccagtatacttgttaatctgtctaaagatattgttttactgtctaaatgtttcctgatccatttttctgccagcatgtaagtttctttctatgtgatattgctattattcatcttttaaaattcagctcaaatgtcatccatttcaggaagatttcccttaaatctcctctctactttccatggctcttttttgatattcccataggataatgtacaagcctctctcagagcatgagcctgaatttattgcaaaattatgcatttttgccttgcccatttcctccaattttatttatagaatcttcaatgctatgtttatagattcacttatagtctcagaataattcttatcatataataaacatacagtaagaaaatttcaaagaaagaaaaacaaaaggaaagataaagcatttgattcattgtctttctattaccaaattctaaattgtttccccttcacaatgctgccttacttatctcaaagagatgttctgacactgacaaaatttatgtgaaagcattttacaaatacagaactatattcatttacaaacaactaataagaatatgtattgtgaagcaatatgtagtaacagaaaaacttgaaatacttggaagtaaaagaatagagatcaaatctcagtatcctttatttatgcctgagtatacttgccaacaaaattaggtcaaacattctaaaatccagatggtttctgtataaattgaaatatttttagtttccccgcctcctcacatggtccataacctcaagtaatctatgtgaaaatttggttaaatagcaaagcattctacaaatataaggtcttacttatggttaactattaaacatctgaaacaggcaaaccattgcaaggaatacacagttacagaaaaaagtagtgtgttttaatggaaagagcatggactttggagtctggcaaactaaattctacttcagccagttaccaagtgtatttgactacaacacttggtctttaatctcagtttctccatgtataaatggagataacaccagttctgtccatttctcaggattctatgagacaagtgacataatccatgggtcagcttttgaaagcaatgattctgaatgcagataaaataaaatattgttattttcttgagcttgaaatacaagaaataattagaatgcgtgagatagagaggaaaatcctcggtaacactacctgacaatgagcagttctaagtttttattttattttgggaaggtaattctcaattcacatcagtcatcagctttaggcctgtgactgtaagtctacattttgatattttaatattagacacatatagtacattacatacaacaaaaagaatataatgttataaatttccatttttcaattaactaattctgattaccactttatggctattttattttattttatttttttggctactttaaaactattacataaatatatttccatgtcctgatagtttttcttatattattaagaaaaacagtcctgataatcctgataatttttcttatattattctcattggtgtttaggtgctctgtgccctaaaactaaaaattaaaatgagacatttctttttgaggacaagccaggacttgaaaatgttttgttttgtgacaatctccatcatccttggcctatccagtgaaaatcacacgtgacttctcttgtcactgcaacaaggcctcctgttctgtttgtgtgtgtgtgtgtgtgtgtgtgtctgtgtgttcccaaccaaacacatatttttcatgctcttgtttttttccaaaatacattcatgttatcagaaatctaatcccttcagtactaaattgccaaaatttaggggtcaggagtctgtgtcactgcagaaataatttgtggttctaaagttctcatagccatgtcccaaatctgattttcaaaatctctttatgcacctcttgagttctccattattttagagctttttcaaatgtttatttactttttaggtaactttaactacttttattctctcctatgtattttaaaattcattttcataacagatacaaaactttagttttgaaaacacagttcgtaaggtttaagaaaatttccatccaacataacatgttgtaactataaaagagagttaaaatagagctgaattaccattttttcaaagattaaagactctagaatgaaattaaacactgcattaaaattgtccatatgtttcttacatgaaatatgttaaaatttaattttcttgttttacaattctaaaattggaaatgtctttgtcactcttaaagaaggacattctgggccagtgtactagatcaatggtgaggggacgagcgggtgggtaaagaagtgagtgtaaaaggcatgtctttattgacaaagaaggattgccaatatagttattctacttcaggtatgtagagcaaggataaagcatatgggccaaagctcatccgattcctgcttttatattatccatgaattaaaaattatttttacatttttttaactattgaagaaaaattgaaaagtagaataatatttctgacacatgaaagctatataaagttcaaatgacatggtccacaaattttcattgaaacccagccaggctcatttgtttatgcattgtccatgacagttttcacactataatggcaaatttgaatagttgtggtagataccagatggctccaaagcttaaggtatcaattagctggcactctgcacaagtttgcctggttcttatcagatgcatccctgagactaaaacaagtgttttctccatttccccatattattataatacagacagcagcccctcctgactctagcttaatcatacatgagcagataactgaggaaaaatgaatattacaatattaactgaaataattgtgagttgtttttaaaaaagattctcaggggaaaaagtatacatttatacatttgtaaactgcatatttgcaagactacaatcatttaaatatgttaactttgttttatggcttggagtatgatatatttcggcaaatgttcacatgcacttggaaatcatgcgtatgttatataaattaatttaggtcaagttatttaaatgtgttgttccggccttctgtatttttaatgattttcaggtctattgatctattgattgctaagagaagactgcttaattctacgattatacttttactgcatttgttatttttttcctttcagtttcattactgtacactttccttttcttactatatgctttccattttctctgcttctttttttatcacctctcttgacttctgatttatgaaatattgttttatcattacacatttatgtgaatgtagacagatctagatctatctatctttattatcttgaaacatatatactatttacactgttttagaaaatctgtattagatctctagggctgtcataacaaaacattacaaactgggtggctaagcaacagaaatcaattgcctcatagttccagagaccaaggtgccagcgatgttggttacttcggagtgctgtgaaaaagagtcggtttcacggttctcctagcttctggtgatttgctggcaatattcatcactcattgaattctcgatgtacaaccccagtctctgccttcatcttcataatgtgttctgtcttgtgtgcttgtatctgtgttccccttcttataaggacaccactcatttcaattaggggccaccataatgatctcattttaacttaattagtgctatgaagattgtgcttccaaataaggccaaattcttaggcaatggggtttaggaattgaacatataactttaggggtacacggttaaacctataacagtagctatcctagtatacacaaaacaaaatgcttggcaaataaattctaacattaattggtactttttttttctaacacagttcatgcaagtatgtcaaaataccataactccattaagctaactcttgacaaatgatgtttttgtaaatgtttatctatattttaaatctcacaggggttattttttatcccttagctttgcatatatttaagttttctttgttttttttttttaatttatttgcacatcttcaagctttcatctcaaattatctcctgtttgctcaaacaatatactttaaattttattttagagtgtgtctacttgtaataaattcagaaaatatatcatatggttatccttgaaagatatttttcttaaaacagaatcctatttttcagaaatcttctgtgacatattcaaaatattttatcatcttatgaattccatttcttcatatgaaaaattagttgcatttcttacttttattcattaacagttcactttttctctttttaccctttggcttcttgtgagattttatttccaagacctaccaaaagaaaatcctcagctacattatacttaatggtgaaagactgaagttctccccagaaagattaggaacagaccacaacattgtactgaatattttttccagggatattagggaaaaaaaagtaagacaacttatttggaaagggacattaaaactatctctatggcatatgacacaattttccatatagaaaattctaaggaatagacacacacacattcacacacaaacttagaaccaagagtgggtttagcaggttcacaggatgaataatcaatacatgaaaatcaataatatttctgtacacatgcaataaacaatccctaaatgaaatcaagtcccattagcaacatcttcaaaaataataaaggctaatatttataatggtaaaataaatataatcaaaagtaatataagagctatatactgtaaactacaaacttcactgaaaaaagttaaagaagatctaaacaaatggaatgatgtcccgtgttcatgaattggaaaattcattattaaggtggcaaaaattcccaaattattctatagtctcaaagtaagccctactgaaatccaagctgattttttttagacattaacaagctgatttgaaaatgtttgcagctatgacagagtcacaaaatcgtccaaataatcttgaaatagatgatcaaatttggaagacttgcactttgtatttttaaaacttaccacaagaaacactaataaagacaatctttactaacataaatgtagttataaaagatccatgatggaattgtgaatccagttatatttcctcacatttatggtcaagtaatttttaacaaggatgctaagatgattcaataagcatagaatatccttttggtattattttgtttatccacatacaaaatactaaagttggacccttatctcacattatacaaaacaaattactacaaatggaccaaatagttaaatataagagctaaacctataaaacttttagaagcaaatctatgaatacaccttcatgaccttggattaagcaatagttttttacatataacaaaatcataagtgacaaaaaatattaacatattttatgtttcaaaggacaccatcagaaaagtgtaaagacaacccatagaatggtagaaaatatttccaaattatatcttataaggaaccactaattcagtatatagaatgaactcataagataacaataaaaaggcaactgtctcaattaaaagtggacaaggaatttgaagatacagttcttccaaagaaatacataatataaacagtcaataagttcaaaaatatatgatcactatcattagctgttagagaaaatgcaaaacaaaaccataacgaaataccccttcacacccactaggatgacaacaattaaaaaaagatgtaacaactgttggtaaaatgtggagaaatggaaccttgcatataccattggtgggaaggtaaaatggtaatgcactttggaacacactttggcagtccttcacaatgtttaacatagaggtatcatacagcatagcaattttatcctaagaaaaatgacaacatatacccacacaaaaatatgtacatgtatgatgatagcccaaatgtatcaactgatgaatgaataaacaaatgtggtagatgcatacaagggaatatatccaacagttattttaaaagatgaatggattgtggatataggctacaacattaattaaccttgaaagtattatgttctggaattaaatagtggcaaggattgcacaactttgtgagttttctataaatgggtatattgtacacttttaaaaagtgaatttttatggtatgtgaattatgtctaaaaatacttttaaattaaagatcactttctctttggttttctgcaattttgctatgaaatgcccaggggactatataggtacatggatacacagatatatagatggattaaaagatagaaggataggaataaagatagataatttcaatcttgctcctgccttatagaacttctggaaactgacttgagagtacctgtttggggcaactattgattattatatctccgaatattgcttctgtgacattctttatcactgtgtcttttgggattccaagtgcctgtattttataccttcttcttttatgctctaacttgatctattttatatattttccaactgttcagttgcttgaggttcatttggtataattatcaattcccataccttcctttttagctgtgtttttttggtgttatgtttctatattttgtttgtgatttgtttattgctttgtttcgattttagaattttcacttgatatttttacagcttgtcaatcttaccatttcttcttgaacagagagaacagttattttaaagtctacctcaaatgcttgcagcccttggggactgctgtattctctatttttttctactagtttttgttcaaattgtcctttttccttaaatctatggttatttctcaatctgttagtgacatgacattttttaagttgctgatggaaagcatgtgaggcagggaatgaaattatcttttcttatataaaaagtaaatatttttacatttggcaggcctggaagttcagtagcagtccagtaccaccaaaatctaattgcaaaaaataagatggcttgaaatggtcctgtagttcatgagtcttagtcgatttagggctgccataacagaataccataagctggtggcttacaaataatagaaatttatttctatttcattctggaaattgagacttccaagatcaaggcaccagcagactcaaggtgtggtataggcctccttcctatctcttcactgtctcttccctgtaacatcaaatgacagaagaggcaagctatctctcttgggtctgttttgtaaggacactaatcctattcatgagggctacactctcatgacctaatattgccttaaaggctccacccaccctccaataccatcatcttgggggttaggatttcaacacagaaatgtagagggtacacaaacattcaggtcatagtaccatgtaaggatatatttatgttcaagtcattcttccttttaaattgtggccactttgaggttttcaacttctttcaagacgggattttactaggcaaactttttaaaattttgtaccagatagaaaatatcccctctcttcctcaattttttaaagctattgagtttttaatctcacaagcaactttttcaaaattggccaaagagatcatggctgatatctctggatatccatcttcttacattgctttggtgaaaattacaaccattttacctttaccatgttttaagacatatcaaaacaattgttcagcatttttaattgttctaagcaggaaaagtgatctatgagaaatcattccctattcctgaacatttactttatgtactaatgtacttgtattgttatgtgactgagtccaagaagaaaggtttttgggataattcatatatatgttttcaattattttccataatgaatctgttttcatgtagagaaaaatgtattctattatttttaactagttgattatctttcatgaaattagattggaaaaggccaagagctgagttggtgcactatattagtaccacagggaatacccaatgtccacataaatcacacctaagctgtacataattgtgcaagataacacaagcaaatatgataatttgtggcattgataaatagtttgcataaatatttaattgctatatctaaaatgtttaaaaataaaaatacaaatatatgtattacgttctatttttaaatgtttacattttaattagagatatcagaaaacacagtataacctctaatttccttggatattccattttccagataaagccaaaataaatcagccaatacaacacatgctttttcaattatggtactttttacaagagttaaaacaattatttaaatgtaaaaaattaaacataagactgtgtggaaacttttaaaggcaaaatttttttttgggtgagagcaagtctatatatactgacttctacctaactacagtatccaaacttatgctaaataaattattttacattctataatgatcctcaaattttgagtgcacttacactcttctttctaatatatgtaagtcttttaaggatgttttactaaattgttacactaaacagttggaacaacttcctttggtactatacacattgagaagagattcaatgaaacacactaagctctagcactgaaaacaaaaattttaatgtgtattgccttgaattgtatgcaataaaacagaagagaataagcacagattattgtagtgcaatcttctaaaaatgggaaacttactttcacctgcaagaactatttttgtgataaggtaatgatggtgctataaaataattatagggacactttcctgagtgagtcaatttagagaacagctaaataagtcaattaccaaagaaccccatggtgaagatgttggatttttacaggttttagaacacacatacacacatacaaatacagatgcacacacgcgcgcgtgcacgcacacacacacacacacagagagaggagagaaagaaagaacccattgaatgatagaaaagaacatccctgaaatgaaaggtacatggagttttttgtcatatagaaaaaagaggttgattttaaaatgaactgacatttttgaggcgaatatattatactataaaccattttcttgaccacaaaaagacgtactaaagtgggaatgaaaatgaaagcatggccaaatgatctagctctgttgacatcctatgagtctaagtggtgatctaaatttcaaagaatttattacaatttctggaaataggccagttttctgccaacttaaaaggtcagaaaataactactaaacttattggtacaaggtttccaaaatgtctaagccaaaaatggtttcaatagcataaatactaaaagtagcttatttcatcttatttaaatattattaaaatacttgaaacctgaggaagcacagttacattttaatacatcagccaaatactatggcattaagaattgaattactactaaggatcaaggaaatagaaatcaatgacatctaagatgaaaaattaacaacaaaaatcatcataaattttctcacttatttttaaagttatttagaaatctttgaatatccaataacaaaaatgagaaatttgtaagacacaataagattctccaaatgataacagttttcaccacatttttctcaataattttatattttaagtggcaactctctcccttgacttatgaaaccgtcaactactttctctcctccaggcaactccaacagacaatgaataatttactcataattctaattaaaaactgaatagaagctgcacagcctgtgtaagttataaggcagtgtactaattatctgttacttgaattttaaatagttataggcagctttaggaaagcatgtatagaattagcaatccaaaccaaaccagtttcctgaaaacactgttgagatattactgatttcctaattattgggtcttacatgccttctaattacccttacaatttatatcctttctttttccatgaaaatacataaactatagtcatctactatgaacaggtaacacattaaataatccccatgatatccatgcaagacaatgattcttgtattaattgctgatcttcttcagaggctaaacctttacttaacttttcaatgcttacatttcaacttttatgtcacaaagtccagtatgctattcatacttatgaagttaaacagaaacaaagaatttcaaatgtaagacccaaaatgccagatgcatatttgtgtatatgtggtaaaacccaacactgaagtatatttctttagttgtgcgaggtcgtttctggtgctaaaatggaactggtgatgacaacagttcacaccaagaaaaaacaatcaaaactctgccacccaccctaccaagcaaacactgctcacaggatcatttgacctcatttttatatgcattgttcattctacaggaaagataaagctggcaaattccaccagaggaaggtaaactattttttaaaatgtttcttgacactgtaattctatacatgactgaaagtatttttaaggactgagaagaaagttattcaatataatttttgttgtattttatttaattaaaaacagttgttttaacttacttttaattttaccaagtattatataccatgaatattatgagttaacagaattttattaatttagaaagtagccaatagtgccatgttaggaaaatatatgatcatggaaatttcccagaactccaaatgtttagtttaactttggcataaattttagaggaagaacaaatagtaaactgaatttaagcagggtctccctcttatagagaactgcaatactcattgaattattccttaatatcacaattaagttgataatttatttttatgaaagtttgtacttttgattaaaataatcataggataaatcagtctatgatttcatagaaggtaaactgagttacagaaaatctttgtctagccttagccttttaagtatattagtaccttggaaatcctacttgaaagtcagctgatatggaaaatatgcccatgcaaacatcatctaaatttctttctcaagtgaaattttgacaaaggggcatacatacaccaataagaatgctgacaaatagcatatgcaggttcccaaagcctatgatattggccattctgcttcctgaagagggaaagataaattcaaagaatatatttacctatttatgtttaatttattgaatatagatgctgttactgtttttcttaaatgtaaaacatgtaccaaatttatattaaaaattcattattttatatttctaatatggcaatcagctattcaagtagaaaacaggaaggaggatacagctgaacagttcataaggacataaaacagatttgtattttgttaacagtttccaattttggtccttgcaaacttgtttaggaaaaatgagagaacactttgataacatggtcttgagaggtctatattaatatcacgtcaaataatacttattgagagtatttttatgttgatcttagataagagaatagtatcttgagctctgtaattaaaacatagaagacatagtatgcttgacatgtattatcagaacatgaaggaacccagtgtggtcaagggatcaaatttgtgttgcactggtttggaaagcaatatgagccctaaagcctggaaatttaaaaaaaaaaaaacttagagccttatataagaaacatgaattttaattgaaattctctactttagaatgtacagctttatcaagaagataataaagaagagattaattagcttgtctggattctggcagcagattccatcatgttggcctaagagttgcaatggataaccttatcccatcttaaattacggtggtgctgtgatagccttacatttgttatgctataaaaaatattaaacttcagtggtttttcatgtctgtagttcttttggaacatgcttcccgaaaatgatgatggtttatagatcacgttctgtagaactgtaaaatatttagcaggagtgaatgagacagaacttcttgctacttcactgtaaatctactaacctctctaaaatatgaatcagaagaataaaatataaatcaaaatagaacgggggactcaccaagtattacaaaaaataatatgtattatcaaacaccaataaattttccctgacatctaatgttggtcttacatttattaaaaaatgtaacctttgaagtacaactttacatgaaaacctattttaaggaatcataaagagaaggcaatgatgggattatataacaatttttcatttccatatgagaatataaattattaagcttatcatttttctttttattttagtaacaaagacattactgaatgttgccaacagatttaacattggcaaatcatctgacatacagcttaatctcctatgatacaatatatgaatatatagatgtaattctgttgtatgaacaaaattgttatagcacattctggaattgattaccttgaaactaaagtaatagattagagttacttgaaatttagttgcatagtaaggctaaatcttaaataaatatgctacaattacattgacagaataaaagatttttactaaaatttcatacatagccttaagtgtatgcttgagtaatcacaacgtatatatagcttttttcttaaagataacataaggactctgacttcataaagattgaataaaatgagaaataggacacaccaacccacatgatacaaaataataaaagctacaagaaaaaaatgctataacagggacacagtttgggaaatttttaaagcaaacttcacccacaaacccaacagatggtaaatctacatctgtttacacagcttataatgaccactttcttatgtagaaaaaaggctgtgaaagagaacataattttatataaagcacactccacattacatttatatggctgtaaatatggcctagaactttccattgctcatcattgtccacaaatatttctcactcttttccattaaactaagcacaagatacatcagttgatagcactgatttctaaatacaaatttcaaaaatatttgtaatttctctgtccacctttgaaaaaggaaattgccattagactttaacattctacaaattccaaaactctttatgaccagaatagagtccccaacatttgcttaagccaatcactgatgatttatgataatttaaagtcaattgatatgtcaacagtagttggaaaaagtttgtgaataataccaagaacaaaatgtcttaaaagattttagaagataattcgatcttctaaagtttcatctgacaatgaattttaaaaccagaaaaaaatagctgacattcatgttagcaagcattttttattccacattctctatgcttgactgatccataaattgttgcaaatcatctaagtgaagcactaaatataaaaagatgagcactggaaattttcataagaaattacatttgtatgtattataatatgataatacatatcacatttaactcatattgcaactaaatattaacagaaattttggcagctgttaaaaagttcaaatattcactcatgtaaaaatatgacatctatttttttcttaaactaagattattttttgttcatggatacagatacaaataacctctctctaaagtcactccttatatagtatcattcatttcacaaaagccagcctgaacatgtcacacactgaaattcaaaaggttttaatgaaaaagtctcttttattttttgaaacagtaccattgggatatctgaaaagggtaatacagttagagagactgtgaaaatggttctatcacaaacaaaaatagtaggtcaagaaaaggaaaggatgttttaaggtaagataatatcattcattgaatttggatctactgagtttgaagcattgatagaatgttcaactggaaacagttttcagacatttggaatataatagtaaggcaagcacaggagatgtgcttaagctatagtaaaaacttttagatactataccagtcatagttaaagttacaaactatgcaggatatccaaggtaaataatgaagacagagaagcacaagaaaagattatttgagcaaagcatatcatttgagtggtatgagaaagaagagataaggaaaccttactggaataagtggtgctctcaaaaaaattaaaatgaagaaaaataaagaacaagaaaagagtgttgtttgtggtcataagtgaccagacaggaaattattcataaagcatttctcactggttttataaatgagtaacaaatatgaataaacaggtataagatcctgaagtgtaagtttatatatgaaggtgaagattttaacaagtggacttgagatcatggatcatgatgaaataatatcaataatggtgaatgacactgagtcaaaagttttgtgtgataaaatattctaatttaataaaatcaacaaacaactgactcaatgaatatacaagaaccataacctttgtagaacttactaatttacacacaaggcataggtatgcttagttagttgtgcttgttaccaaaatgccaatgagatgtttattttcccccaaatctttactgcattatcattaacaaataaaaattgcatatatttcatatatgctttgatgttttgatatatgtaatacattgtggaataattgccacaatcaagataattaacattcttcacctcacataattaagtgtgtgtttgtatgtgtgtgtgtgagagagagcacttatgatctattttcttaggacattttaaatccacaatacagaattgttaactatattctcattgctgtacattagattttcagaaattattcctcttacataactaaaactttttatcccttgaccaagatcttgccatttcctgatcctctcagcttctgggaactaaaattctactcttcatcagttgtccttgttatgcatagctaaatgtatacttaaaaccaacattgtaaagcaatgtagaagtcaggaaggagctctggtccctgtatgttgacttcccagacgaaaattagaaattgacacagaaatagcaagataatttagtgaatagtaaagattcacaacacaaaacttaggttataattttacttttatataatgacattttatttaaaaaaaactataacaatagtaaactatattgaaataataactttctatatacttttcacttaaatcaaaggccttacttgtctatatcaacttccattcttcatccacataaaatcctgggatttaagtttctccaccacttaaagtctatgtgaaaagtgaggaagtattttcaacaatccaaatttcagttccttgtctataaattagagatagtaatgtctatgcaaagattttaagaattaaatgattatataattttgcaattatttttttaaaatttgaaagcttacctaaatggtgggtaacatcatttgaaattatttgcattaagttgcagtaaaatacatgctaattataaataactagaacatgttaattttaagaaaattaaaatccttcataattgtgaaataatggaatttttaggtatatgtttttcatatgtcagttcatatcattatcatatacctttgtattctggtttttaacttagcactatgataatttaagtgttttccaaatcattacttattttaaaaagtgtcttaatgcctgtataaacataacattaatttgtgagtgtttcaattaactaagggaatttgtaatttttaacttagcattttgagtactttcagaattttttataaacaagactatattcaaaaatctttgctggcaactaatttgtctgccaagatttcattagaaaaaaatgtcaagaagtaatttagccaggttaaaaagcaatcacatttcaaagactttgatgtaaattatcaaattggccactagaaataatttgcgattattcatccatttgcaatttgaggaatagttcatggcatataccctccgaaataaaatgggcattatgttaatatctttctaatgtgttagaataaatattctattttattattatattaatttgccaattaagtgtttgtcatagcagttgagtcttttactatatttcaggattgtttgtagtttgtaaacacgtttagctatacgattatgctatatatattcttttgtatctgtctttttttagcaagtttgttctctttccaattcagtatctgtgtatgtgcatataggtacatataccctcacatatacatacataattattttaagtctgaattgcattcagagatggctttaaccagtttctctaaatggacaaatgaacaatttttttttcatgttggcaaattttatacataatctacatagatcactgtctttttttgttaatgatataattatttggagtcatttccatgaagagtaattagtgagtttaaaacatgtacctatgttacttgatgttactcattgtaaaaatgccttccagagacgttttagcaatgtatagcaccagcaacaatgcatcatgtatgagaatgattttttttctccacagatcattcccagaattagatttcagtttgttagtccctttcacttttgtggggcactaaggagttaaaataaaattgacaaataggtttagcttgcagaaacagacaaatgggtaggtgggagtgaatgttccaagaaatggggtcaactgcaaacagcttactggcaccccccgagtatcctgccacaggccctgagctcaccagctcacatgcacccaagcatcttgtctgtaagcattcagactaagcagcatgaccttataaaatttccctctagctcctgcctctttgcagacagcagagagccttctttttactatcttgcctgttgctcccttgcaacgtactgttcccttttctctaataaatctgtctttctaaacttgttactgtcttgggtaaattcctttactacccaggcgccagcctctgacagttgaccatgacaactttgtctaattttgactgaagtaaagagaatggggggtggagacaagatggacgaataggaacagcttcagacgaagaaggccattacataatggtaaagggatcaattcaacaagaagagctaactatcctaaatatatatgcacccaatacaggagcacccagattcataaagcaagtcctgagtgacctacaaagagacttagactcccacacattaatagtgggagactttaacaccccactgtcaacattagacagatcaaagagacagaaagttaacaaggatatccaggaattgaactcagctctgcaccaagcagacataatagacatctacagaactctccacccgaaatcaacagaatatacattcttctcagcaccacaccacacctattccaaaattgaccgtatagttggaagtaaagcactcctcagcaaatgtaaaagaacagaaattataacaaactgtctctcagaccacagtgcaatcaaactagaactcaggattaacaaactcactcaaaaccgctcaactacatggaaactgaacaacctgctcctgaatgactactgggtacataacaaaatgaaggcagaaataaagatgtcctttgaaaccaatgagaacaaagacacaacataccagaatctctgggacacattcaaagcaatgtgtagagggaaatttatagcactaaatgcccgcaagagaaagcaggaaagatctaaaattgacaccctaacatcacaactaaaagaactagagaagcaagagcaaacaccttcaaaagctagcagaaggcaagaaataactaagatcatagcagaactgaaggaaatagagacacaaaaaaaaacccttaaaaaaatcaatgaatccaggagctggttttttgaaaagatcaacaaaattgatagacctctagcaagactaataaagaagagagaagaatcaaatagatgtaataaaaaatgataaaggggataccaccaccaatcccacagaaatacaaactaccatcagagaatactataaacacctctgcgcaaataaactagaaaatctagaagaaatggataaattcctcgacacatacatcctctcaagactaaaccaggaagaagttgaatctctgaatagactgataacaggctctgaaattgaggcaataacagcttagcaaccaaaaaaagtccaggaccagatggattcacagccgaattctaccagaggtacaaggaggagctgttaccattccttctgaaactattccaatcattagaaaaagagggaatcctccctaactcattttatgaggccagtatcatcctgataccaaagcctggcagagacacaacataaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccgtatgattatctcaatagatgcataaaaggcctttgacaaaattcaacaaccttcatgctaaaaaatctcaataaactacgtattgatgggacgtatctcaaaataataagagctatctacgacaaacccacagccaatatcatactgaatgggcaaaaactggaagcattccctttgaaaacgggcacaagacagggctgccctctctcaccactcctattcaacatactgttggaagttctggccagggaagtcaggcaggagaaggaaataaagggtattcaattaggaaaagagaaagtcaaattgtccctgtttgcagatgacatgattgtatatctagaaaaccccatggtctcagcccaaagtctccttaagctgataaacaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaagatacaaacaagtggaagaacattctatgctcatgggtaggaagaatcaatatcgtgaaaatggccatactgaccaaggtaatttatagatacaatgccatccccatcaagctaccaatgactttcttcacagaattggaaaaaactgctttaaagttcatatggaaccaaaaaagagcctgcattgccaagtcaatcctaagccaaaagaacaaagctggaggcatcaccctacctgacttcaaactatactacaaggctacagtaaccaaaacagcatggtactggtaccaaaacagagatatagaccaatggaacagaacagagccctcataaataatgctgcatatctacaaccatgtgatctttgacaaacctgagaaaaacaagcaatggggaaaggattccctatttaataaatggtgccgggaaaactggctagccatatgtagaaagctgaaactggatcccttccttacacctcatacaaaaattaattcaagatgtattagagacttaaatgttagacctgaaaccataaaaaccctagaagaaaacctaggcagtaccattcaggacataggcatcggcaaggacttcatgtccaaaacaccaaaagcaatggcaacaaaagccaaaattgacaaatgggatctaattaaactaaggagcttctgcacagcaaaagaaactaccatcagagtgaacaggcaacctacagagtgggagaaaatttttgcaatctactcatctgacaaagggctaatatccagaatctacaatggactcaaacaaatttacaagaaaaaaacaaacaaccctatcaaaaaatgggtgaaggatatgaacagacacttttcaaaagaagacatttatgcagccaaaagacacatgaaaaaatgctcaccatcactggccatcagggaaatgcaaatcaaaaccataatgagatatcatctcacaccagttagaatggcaatcattaaaaagtcaggaaacaacaggtgctggagaggatatggagaaataggaacactttcacactgttggtgggactgtaaactagttcaaccgttgtggaaatcagtgtggcgattccttagggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccaacaaggatagactggattaagaaaatgtgtcacatatacaccatggaatactatgcagccataaaaaatgatgagttcatgtcctttgtagggacatggatgaagctggaaaccatcattctcagcaaactatagcaaggacaaaaaaacaaacaccacatgttctcactcataggtgggaattgaacaatgagaacacatggacacaggaaggggaacatcacacaccggggcctgttttgggtaggggtaggggggagggatagcattaggagatatacctaatgttaaatgacgagttaatgggtgcagcacaccaacatggcatatgtatacatatgtaactaacctgtaggttgtgcacatgtaccctaaaactaaagtataataaaaatatatataataataaaataaaaaaacaaatccaactttaaataaagggggtgttaaatgttaaaagaaaaaagagaatgaaacttatttttaaaatttgaacacaataggctattaatgaaactttatttaaatctttatatttttccaggccaattttaaagcttttaaaagttttgtttttttaattctgtgcccatttttagtaaatatagtatatttttcttaatggttcttaaggttttacatcataataatgcaaacatttctccaaatacttgatgtttagtatttccacgtcactgcatttagtgcattttcatgattttttaaatttccttgacatgttttgtatttccttgacatatataatattattaaaacacacactcaatcataatttaaatgctaatcctcacaaatctattagtctcaattttgtttaattggttttttttgtagtagatatataattttttatagtgaattacatcagtcttttctgtttacttcttttatactttgtaaggaattggataagtctcaaacaagacagttactcatcattctgggttttttgttttgttttgttttttgagacaaggtctcactctatcacccaggctggagtgcagaggcacaatcttgactcaccgcatccttgacctctctggctcaagtgatcctcccaccccagcctcttaagtagctgggaatacagtcacacaccaccacgcctggctgattttttgtatttttttgtagagacaggatttcctcatgttgcccatgctggtctcaaactcctgagctcaagcaatcttcctgctgtggccttgaaaactgctgggattacaagcaagtggcactgtgcccagcctctattctgttcttctttcatctgcatttatgtttaaaatttcaacttttaaaatttaatttttaaatgttgagaaataaaggacagtattttttcgtatagttattacctgaacatttattaaatgattatttagcataatgccatatgttctcattcttaatgtgtttgtaatctctcaattggttgcattttccatctgtcaaaaggtctcacttaaacattttaagctttgctgagtaccttttaaaaagtgtaaaaagggtgatacaccacaaatttcaccagaatttttaaagtatatattcctatttataattccaaatacaatttcggagttattttgagtttctaaaggatcttctttaaattttatatggaattttgatgatgtgataaaagtgaaaatacatatcttatagtactaaaaagtttatttggaaatacagtatgttctccactcatatccttcttccttaattactttatcaaattttgtgtttgtgttaccagttatgatatatttcttgtttaatattttttcttctaattttatatgcttttaaactattataagtgtactgattttattatactttctacccagttagtattttatattttctatttttgattctcttgaaacaaatgtgtcatatagatggagacactgaagaaaaaaataggaagattaggattagggaaaggttagggaaaaaaagtgtagttggtattttcttccataatcaatgagtgaaataaaattttctcaagcaatgactgcattgttacctcatcctcctccccaaacaaacattttaagctgaaatacagtgtgtctatactgcacttcaagaaatactttagctggattaatatctcaatggaatcggaattccatggaacataattatatcatttgactaaagtaaattcatagtcttttgttgcactgacttgtccttagtttagggttagttataaatactttcagaatatgttatgaatgactttaaataaattgataaagtaaagtcgcataaaacatcgtgatgtgttttaatctgtttgtgctgctttaacagaataccacagactaggtaatttataaggagcagaaatgtataggctcttagttctggaggctgggaactccaagatcaagcggccagcatttgattagagccttcttgctatgccataacatggcagaagtcatcacatggcagaaaggcaaacagtaggagagagagcaacaggagtcaaacttacaaccatgataatgataacagcattaatctattcatgagagccaggacctcatgactagccatcttttaaaagtcccttctcccaatactataaaaatggcaattaaatttcaacaagagttttggagaaaacaaacattcaaaccatagcatgattcaaacaaataaacagcaacaaaccgagaacaaatatataaatcctgattttaaatttaaaaatcaacaaaaggctaatgcataaaaataatcattgtaattccaaataaatacagattcaaatataaaataataacattaataataacatatttttaaaactgaatttaaaaataattaagaaaaataacacctaatgctgtaagggttttgttattcagtctctggaaaaaagtctaaaaaccttctggaaagcaatttggcttcacaaatataaaacctcaaataaatttatatattttgacttatcaataaaatctaccccatttctaggaaatgtattattaaaatatgataaaacgtttggataaagatgtgaagacactaatgtctggcacaacactatggaatgtttattttggatagatgcatagctacaataaaatattttgttctagtatgtaataaaaataaatttgaagtgggaaattttcatacatattgtatgtaaaaaagaaagaaaaaaaaaactatatgtgtgattgatctgaattgctcataatttcaaatgttatatattgatataacatttcatttttatcatgaagaaagatgcacatagatccactaaaatattaacagtctctagattttcagattctagatatttataaatcattttgatatacttattacatatcttatgaagactagagagtagagtacaccaactttgtgacatcatgtcccacccaaactagaactttttcaatacaagtgttgaccgaatttatgcaagtagaattcacattcagaacactcagactcacatattcagaaatatctatggcagccattgccaccagctctgaaatcttagtttcagagcagcatccagttttagagagctgagctgaaagacatttagaaaacatctattgcatcacatttgttctacagatttgaaaatatggatcactggagtttaatcaatttattctaaacacaaaatattgtaaccaatggtagaattacgatcataaataaagcagcataatttttcttggctgtttccagcgtgtaacctaccttactttaatttcaaagaagccatgaagactatgacatgagtgctaggctctgttatatttctaagctatgtgttcgttctttttgttttttcttaggagaatggcactgtattttgggcacagttcatcaaggaaaaacagttgtcttaagcaatggattttagtgacggctagttgattgttacctggctactatttatagtatgttcttggttttattatgtgattttatttaaaagttacatagaaaataagaatttaaagtagaagtcccagttttactatgtccatgatatacactcagaacattgatattctctttagaaatgaatatttaatctccacatccacttttgtcagaagtaagttatttaattgccaagcactttacaaattacttctcttcacgtattagttccctacaattcccgaactataaacacaggtataatactaacttgctttctgatattgcagataagaaattaagtagataatctgtcttagatattatctattagctaacattttcactgattattggggatatattagataacttaactttgttcctgaaattatttgagagaactttacctcaacaaaaattgaagatgggaatgagaatttaatgttctttaagaaaatattttgtgctcctgccaatttgtgagagttaaaatataggaaagatcacgtttcatacgaaaaatcacaattcactacttcctcttgatatgggatatatggacaaaaattactctttaggcatgtagaggtctagtgcaatggtaatgaaataagtgggatgatagagtgtgtctgagtctattggttttaaactactcctgggttactggtaactacatatttgtcactaagcctatttaatacagttccttaccttggggattgaactatacaacacatgagtgagaaatacagactgaaatgacaacaaagatgaaatgatggagataaaagtactttggaaatgagatgatagaattcactaagaattatggatcatttcaaattcataaacataaatatctactttaaaacattacaattcatggaaagcacttatgtcacttaaaagattgggcttcagaacggtgtcgcctcttaggttaaggtggcaagtgtaaaaagtcaccatagcatcacagtacttgaagacatttaaatggaagtattagttgataccatgagacttttaattttgacatactattgtctttgatgatattggatatatttcttccataaataaacaggttttgtttaaatggaaaatatgctgaggcaagtagaaccccttttttatatttcctcaatgagaaactgtcttagcagccaaagtaacagcgttcactattattgcctcaagggttgggcagattccaataggctgggaacacaggcactatttggggttgtatactcaagtttagacagaagcagtctggtcacatgaaacttaatcttttaaagtgttatttaaacacattctttatagtttaaattgtaccaaatttattctaggcacacacaacatttattcaatattcaatttacaaatagaacttatgtgatttcttagtatagttttttggttttatattttgagtaaattttaagaccttcaaacaagagaaaaagccatcagaaatagattactcagggtagggaggacatcaaagaatagaggttaatttaacaatttctagatttcttcttacagttttttaatgtcaagtattaaaatagcacgcattttttcaacatattctagcctcaactgattttagaaagtcaaactcatgtcaacatgtcattttatagacatagaatgggaaagaaaataatagtacagccagagtggcaggtatttcctgcaagaatatgaataattccaactttttcatgcagttttcacttctatttgagaatcagggcttattctgttattattttgtgtttgctatgtattttatatagtgttgtcagttaagcaagttaaataaatgcaactggtcaaactgtgaagactcagtaataagcatcaaaaataatttagtttccaagaaaaagcaaactcttctttgtcaactgagagacatgtctattgagaaagcgtttcattcaaacttgagaaaaagtttggtaattatggctaccatttactctgaaaacttattggaattggtatattcatataaaaatattgctaattttatttttcccaaattaatttttgcctttgagattcacttgaaattaaagtaacttgaaactaaactatgttctttttccttctaatttcactgtccctatatataacaatggcttttcttaagacattagagtagcattccttcgtaactgatgacttttacattaaactttcatgtaaaattatattcaaatttgctttcaagtctctttttaaaataactgtttttactattcaaaaaataaatcatagtgaaaggttaataaagtatatatactcatatcaatcttattagaaacacaatggaagttatatcaaatattttacaagtttctcaattcacattaacctagctctagaagtttcttctgttctcaattcaactggaagataattgtcttgactaggaaaaaatgctaataatgagactgtcaatatataaactataaaagttaatggaaataaaaaataatcttaaatgcataaaatactaatgaatacaatgttcacaatattagcattaaaagtggtcttattttcttaaaaacaggtttgtgttgtaaacaaaatacaaggaaatcttctattaaaaatatatgcttgagattcatggtagcttaaatttatccagggaaaatattttacaatatgtctcagtggtagtcagaataatcacctccaaagatatttatatcttaatcctcagaacttgtgaatgcgcatgaatgcacacagcaaaggagaattaaggttgcagatggaattaatgttctaatcagctgactttaaaatacagatattattctgaattatctggcaggtcccaatgtaatcacacgggtctttaaaagtggaagaggaaagcagggaagaagttagagtgatgcagtgtgaaaacttgatcctttattgcatgcaaaaaaaaaaaaaaaaaaagatgaaggaagagggccaggagccaagaaatggggacagcttctagaagatggaagaggcaagaaaacaaattgtttcttaggggcttcagagggaatgcagccttgccagtatcatgactagcccagtgagacccattttaatcttctgaggtacagaactataaaataaggaatttgtgtagttttaagccataaaattgtgtaatttgtaaaggtaaccatataaaattaatatagcttctatgaatacctctatcttaattatatagttacagttttaattttttttataatgcatatcccttgaaaagttgtaagcaatatagcatgtgcttaagaggcaaaaaggtaatgtgaaaattttttaaagtataatttattatatatttatgatagtaatttgcaataatgtattatatgtattataaatcagtgttaatgtaccagtctatataaatatctatatgattaaactattccttattcaatatcaacttgcccactgtaaatcacactagtatgctgttgattattttgcaaagtttcgttcatgatgttttcaggtggataattcatgcttacgtgtcatatcctcctgtactctataaaagaaataagagcagccacagcacatgtatcactctatggaacatattaataaagttctcaagatcaatgctgctgagtgcttttttgcaggagcagtttaatgttagtataaaatattgccccattaaagcacagaagacaataaaataaagcaaaatcagcataaataaaatttattaattatgtctcagtgattggaccttttcttttacgttaaagaaggtttacaatgacagcagcgtatactagaaatgatggagtccctatttatccctggtaatgcaccttcttagatcacagttggttagttgtcatcacttaatgtttataaagagctctaaaattgaaattactccctaagtgtcgagtagcctcatcattcctgaacaatcctaatgaagaaaagcatatgtgaccattttgcaagcctcttcagaggaaagtgaatatttaccattgaataaaacaaaacaggaaaacaaacagataaacataagagcaaaagaacaaagtcaaaacaagttgcagaccaatgtagaaagaaacaaaagtctgtgcttcttccgttcaggttcctcgggccagagacagcatgtaggtcatgctgtggttgatcacaagggccacagatgatattccctagtgtttgcaagaacttcctttaaagtactattaataatatagagaaaaatgagaaataagtttagcatgatcattagtatgcagtgtatgtgagtgatgcaaccatcatatacaagcattataactttcgtgggcctattttcttatgctctatctctctgtgtataaaacataaaatatataaatatgtttatattttatgtaaatttatatttatgtttaatttatatatttatatgttatataaagtattttcatgtataaatatatttcctataaaatatttatatattatattttatatgaaatatatgtaatattacctaggctatgttcactattttacattcatcgttattcattgttatactcattttttctttggtttctaagatacattaaaatttgaaaatataatgggcctataaaattttcatgacccctaagtgccgtacctactgtgtctgacgaataagttgtctctggtctttataaccatttgctatctaaaagtgtataccttcagatgtccccaattttatatttgtgataaattcatgttgataagaatatgggcatgctgattacctaaaattcaaaatatgaataggcccagtataaattgtttatgtatatgcattcaagcactagtgtgtttgttagagctttcaaatctgtttccctcttttaatccaaagtgttccaaaacatatttgaatataatgtgtattttctaaaaatattccataatctgcatgtatcacatcttaacccaacaagtaaacactggaaatgactactaatcagggcaagacatgcatgataacatgtaggtgtgggttattactaatacaaaaattctaggaactttcctatgtactctgtaggatgcgaatgagggactgtaaaagtggagaatgacaatctgtatgctaattctgaaacatttgcattgagaagaatggcctgggaaaattgagctaaatctattcccgccttagcaaaattcttcatgaatgtgaaatgctataggttagttaggtaaactagaagcttctacaatcttgtctacattccaagataatgcagtatgctaaatatttttctctagactgaaaatatttctttaaaatgatctgtaattttagcttcctacaaagtcagccttactttctctgaattagaatgattatgtgaggatctgttaaatttatatgtttagttttgacaaaataacacctacctgctaaagaaaattgtaaaaagcgataagaatagtgaatatgttaaatatcatttgacctaatgaatattggttttgttgtggcaaaagaacaaaaaatggaatgggtattttagaccacagtaacagccactcctacaacagataaattactattatttgattttcagcctttgattgtcttttttcccaaagaactcagaaaaatatgctcatatatcacctgtgtaaaataggaacaaattatgttctttcaactgtgaatgccaatcacacacagacatttgcaaatttacatgagatgaaaagcaatttcacggcaatcagctaaaccacaataaaaattacgcatgcatcacagcattgggagagagagaaaactgtgacttgccaaaagaaaatcagcttgtacattactctggccaaccagtgccaataccctgaacaaggagctatctctaggcaaatgacactgtagattgatatgctaacttacccttcaatacagcatgtatgtatctggggatgcagagctacaaagaaaggttctgaccctgtgaaaacaggtgatcaccatgctgccttgtgccatttacaactgctaactagaaataatttggtctattttcagtggttaacttaagggtaatgcattgtattcatttgtacttttttttttttcaaattttaaagacttccaaaatatctattgcttttgaaatctactcagtggccattcagctgtttaaattgaaatggccaatgtaaggaaagaaaaagattaaatatattcaactggccatgataaatacaatccaggtcctttggtgttagaagctcagtatgattaaactgtttttaatgattaggcttttgatttttacacataaagaattcttaatcatgattttttatcataaaaaacaaaaacactcaattagaaaaaatatggatagcatttcccaggatagggcacgttaacaactatttctttccctatagctttttctactctgtgtgtgtgtgtgtgtgtgtgtgtgtgtgtgtgtataatgtgtggtattctcttaaaatttgcctttctatacaagttcacataaaaaattttatgcaccaaattttatatctttttcaagaaaaattgtaacttcagcaaaacaaagattaaaaaatgttaataaaggactataattttttacaaaaaaggctaagttcatactgtactaaacatatctttatcagaagatgtaaacatactgaatttgatgcaaatgtgaattttagaaacccgagctcttactatttttagagtccttaataaatatctaacagtctactatggtttgaatgtagtttgtccccactaaaactaatgttgaaattaattgccattatattggtgttaagagatagggcctttatgagatgactaggtcattaaaatctcaagagagactgggttagctcttgcaataatgaatttgttctcataagagtgatttttggcttattgatccataatatttatatatatttggggtacataaaatattttctcacatgcttaggaagtgtaatgatcaagtgaaggtacttaggatgtccatcaccttatgtatcatttctgtgggttgggaacatgttaactccactcttcaagctattttaatatataaaatgcattgttaactatagtcaccccactatgctattgaatattagataaaaatcctttcatttgcaacaacatggatagaactggaggtcattaagtgaagttagtgaggtgcagaaagacaaacatttacgttctcactcatctgtgggagctaaggaattgatctcatgggggtaggaagtagaataaatccttaacaggttaatttcattattacaacaattcaatgaggtagttatatttttattctattttgcagatgagaaagctaaagtagataaattttaagtaaatgctcaggttcacagtgctagtaattaacctattcagcatctgtacctagaaagtctactgccagagtccacatttatcaccagtttactgtaatgcctcttcctttgtaaccctgaaaattacttatgagaaaacttggctagttttcacccatatacctatataagggacagacatcgatgcgccttttcaaaaaggtgaagtgggagtacagggccagagaaagataaatggaatcatggagtataagtgatgatgccatttttttttctactggaagtttgaagtaatcttggaaataagaacaagttctgtatataagctaggtgagagcttccccaaattcccatccattcatttattgttcaacaaatatttattgagtgcctacatcaggcactgtttcagaaatttagagcttcgtaaggaacaaaaatctctgcctctatctagtatatttactagttgggaagagagttaagtaaacaatataatacaaaagagataataacagtaaagaaaacaataacaattgccaccctgaggtaaaatttgggggatgctcagagcctgagtacaaaggtgtcaaccaaaccacccgaggaccaatgggatcagtgtctcaggacaccagtaagtggatccaattgaaatgcctgcaataataacatcgttttaacttcttggtaaaccaaggttttcaattaaaggttggtttggggaaaaaattgcctttccttatgaataattcaaatggatttcctttgaatttaccaaaattcttcatctgatgagataggattttttctcttttcgcccataaactttgctttatagattgcttagggctactgcctaaataaaaataaattcctgttgcagtatggttttaatatgttgaaatgtattctttaagttgaagatctctgtagttcatttgtcaatgcaacttttctgttcaataggagtttttaaaaaagaaaacaatcaaacaaacaagaaagaagtttacttccttttgctagtgtattccattactacagtttgatatttcaagtggctcatgaattagaaaaacggtctataaaatcaacttataactatctacctgaaagaaacaacagaatattcatagtcacattctttttatgttaaatttaagttttaaaaattaaaatactaatgtattatttataatatgtataaaatgtgatataataaattccagcaactaacttatacttttttgcctagccattccaccccttgtgttttcctccatttatgctggaagcaggcttcatgttcctttgcacaacagcaaagttgtgtcaggacctccagcagaaatcacgttcatttaaacaagtttctcactttgtgttaaggcctttgtccattgaagggcctgtatcccaagtgtgaggagggagaattccttgagaacagcgaagcaagcagaaggggtcctcccgaccctagagaaaagatccagacccagggaattgaggagaacaagtgacccgggtccaatctcctcaaaatagtttcggttgttgttacagtttaaaataccagggagaatctcatgtttgccagttgtttttttttttttagacctggattaccagtagaacactatattaaacctagttggtttatattctcaaagaagagaataggaatatagtctatgggtttctattttttcctactcatttaattttattacaaaggctgtatgttagttgatatgagggatagtgaaacaatttttaaaacttctaattgtaatcattcacatttcaatgtgatattgtgttaagtatgactttatgttagctataagtttgacctggacctttttgtcttatattaaggatttgtgctcctgctctaaaataattggaatggattttaaaatttcttgactttcatatacttttagaaattactacatatccttttgcttatttgacctattggcatgatgtattagtagagttgtttttacaattccatcatcaacttgtaagttattcttctggatatagcgtatcaatatatttcatataagaatgatgcatgtctattcataaaacatcagcctggatttttcattcttaatgctgtggttttacttttgtagttgcttgtgaatctctcttgataaggttaaatactgttttaacttaaaaacaatcaagttaacatacaatttcattgtcatattgcatacttccttttcccttctttaaaaagaactcacagtgatgttatagccatgtctgctgaatgtgttaaatggaaagtagattgagaaattttgaggtagttgaacatcagaacattattcttactagatgcattgaacagagagctaagtatattgctatcttctctagcacttggctgagagcaaccaagcaatttttcattttacttgtgagcacaccatgaacacaccacctccatgtatcactaaaccatgcaaaagcctctgttattcatgcccaagctggcatagagataaatttgaaagaatattagtgaaaaatgctgcttcataccaaacagtattctgtctctgtgtttaaaatgactttaaaaaaataaatcatgcaacaggaatgtctccaaacacagacttctggaataaaaattgccaatctcagagacctagctccaaggaatatcaaccagccagtcatccacctagcatgaaatggaaaggacattatttcaaccttcagtggataatgaatgccttgacacaacctgttttgaaagataattggatatgtaatttgctaaacatactatctacaaggcaataaaacaagttatcccatttatattttttgctatttttctttgtcagtttgccataattttgttcacccataaagctattatttcccaaacgagtgctactagatctagagatggtttctaagcaagtgaaattatctgaaatgtgactaactgaacttcactctttaataggattcacttaaggaatacattatacttttcatgtactcaagctcaaataacctttaccattcccatggttttttatatgttcttccagttaccacatattatttatagtatcatattaagaaaatataaattttcttacacatgcaattgaatatgccccgtccccctttgggattgtttgattcacttatttactcaacaaatcttcatcaaactcttaattttcactcattcaatcacctgcatagggcaatcattcaatcaacattcttgagcacttatcttgtaccaagcattattaagcccttgggactacagcagtgaagaaaacatacaaattcactgcttttatgagacttaaattctggtgtagagagacagaaaacacacacataaatgtatttgatgtgctgagaagtactataaagaaaactaaagcagtaagagcacagcgaatgaaggacttttagtgatggtggtattattgtcgtttgaatagactcattacaaattatctctctgtcaatgttacattggaggaagcacccaaaggaaacaagggagtaataattgcgaacgttttccattaagagggagtggtagggaatttataggtgtgctggaggatagcagaggccagcagcctcaccaaactggagtcaacaagagtggctgcaatggggtgccagcagtgagttagtcaaagaaagataacatcatcaggctctgtagaacactttttggaaggactttgaatttaattccatgtaaattgcattttaaacaaggcttttccaaaggtcattctgtagctttgtggagagtaacaacagtagatgcagttgtaggcactgttagaggtacatgagaggcagaatacaggacggtattgaagaaaatagactctcctttcatggagtttactctctgatgtgggggcatataataacgacgctaaaataaatatgtagaaaggatatacaggttagtgataaataccaggatggacataaaacggattggtgtgattagacaaaaggtggaagctattacttctttttgcttgattaaggatctaataaagacttatactcaatctgagaccagagtaactaaaaagagacagccatggaaagcccattaaaaaagggagttctggaaagaggaatagcatgtgaaatatcacttatgtgagagcagaaaggtggtcagtggttttgaagaggaagttcaatattatgcgaactggagaggtggaggcaagatcatgttgggccttatcagccacattgatgacattagatatatagtcatatgtcacttaacaagggggtatgttctgagaagtgcatcctttagtgatttcatcactgtgcaaacattatagagtgtacttccacaaactgagatggtagagtctgtaggttactgtactgaaaactatagttaagtgtttgtatatctaaacatacctaaacagaaaacatacagtaaaaattcagtatagaagattaaaaactgctatacctgtataaaggacttaacataaatggagcttgcaagactggaagttgctctgggtaagtcactgagtgagtggtgagtaaatgtgaaggcccaggacattattggttttataaacactacatttaggctacattaattttttttctttcttctataataaattcatcttagctaacagcaacatttttactttataaacttttatatatgttttacaatttttggactcttttgtaatgtcagcttaaaacacaagcacattgtacagctctccaaaaatatttaatttatttatataggcttttttctatttgtagtaattataactttttagtacgttttgttgataactaagacagaaacacacacattagcttagacctacacacaataaggatcatcaatatcactgtcttctaccgccacatcttgtcccactggaaggtgtgcaggggcagtaacatgtatggagttatcatctccttgatagcaaggctgccttctggaataccctcgaaagatctgcctgaggttgttttatggtgaactttttgttataaataactagaaagaatatactctaaagtaacaataaaatgtatagtatactaaatacataagccagtctcacagtagtttattatcattgggaagtattgtgtactttgcagaatggtatgtgttacaattttgtaagattggcagtgcagcagggatttttttttacacctgcatcaccacaaacacacaaataatgcattttcctaggacattaagattgatacaatttcactatgcaatacatgggaccaccactgtatatgtggcatatcattgactacagaaagaagtgagaagcccctggaaactttaatgttaagagagcaacataatctgacttatgtatttcgattgactactctttgaaaaatgtattttcatggaagtgagtagcaagaatgacattttggaaagctattaatccaaaagggggatttggttgttcagattaggtggtaaccttgaagatgaaaataaatgaacaaaattgggatatcttttggcagcagagacattaggactattttatggatttgattggggggtgctgaggcaagagacatcagagatgtctcctaagtatttggcttgagagaatgtgtgaatagggaaacatgttatgatgtagaatggcctagcgtagcacatgagcatggtgttaaggaagcattatttctccttggggtatggcaaattagagatacaaattagacatccagtagtcccgtcaagtaaacaattaggttgcttttctaatctgatttagtttaaaggagcatctgagatctaccccaatgagatgctttcatgttactgctgttaaaacaattttatcagaatcctcagtttttataaattatccttttagcatataatataaatatttgtgtaaccatggacttggatgatgcttgttttacttgagtgggcttccactgcaaagtcaaaacctttagccaaaacttcaaaacaggaggtgagtcaaattggccattctccaatgacctgtcagaagtttaagaaattctttgagaagaatgcaaagttttcctactcaattgttatgacatatttttgaggcttctaatatttcattcatatttaaccgacagcagcgaagtactcagtgtatttaaaaataaaacccaaactgaccgaggtctcagactttaaagcagcgtataatttatttagaaaccagacagtgccatgaaaccactagatgctatagagtgtctatcatagcaaatattatataagtgatatgtacatgagatgaaagatgtagataacattattctgttcaagaaagttaaattgacttaaaaatactgaatcatctgagttccatcttggagagatagtaggattttctaagaaaggagaaacaggagtggtaagctgaatagcagaaacaagagcataagcaaaacaaggaaatgaaaataaatagatatttgcattacacctagtcatcatttgaaaggcaccaaggatgcatggaggagagtgactggagatgaggttgaaacaggaaacgtcctagattgcgaaaacatgttggagcattctacagagtttacattgaggatagtataaatcatggatgagtataaacagattatattggggttttagagagaatactctgttatcttattttgaatatgatgaagtaaaggacaagatttcaagaagtgaatgaaatggctcaagacgataacagtgagatttaaaaagacaggaaagaattgtgagaaagatcaaaactagagttattacaacttcctaagtgaatgttttgagtgaaggaaagttaagtgtcaaagataattctgaagctctcagcctgtgtgactgagtgaattgtggtgttcctcaaatgaagatggaaattctatttgatgagggagtagtgataaggcaagaaaagttctgttttgaaaatccaggtggagatgactagtaactagatagaaatgcaatctgttgggcaggagatcaatatttaagccagagaattaagagtcattagcatattcaagaaagtggtaattgctggactccatgaagtccctatgaataggttaaattgagaaaagatctttcagcataaaactctgaggggtgggggctttccaaggagaggcagcagaagccagagtaaattaaaagaaagggacttgtcagagagacaaaagagaaaagaagagatgctaaactaagaggaaggtgatttttaaaaagaaagctaagaattgacacgaagtacagttattgtatataaatgtgtatataccatgacccatatttcttcattattgaacactttttactttcatttgagtattgtcatccctctgttctttaaattgctctaacatctttcatatttctcgaaattctaaatattaaaaaattgcttagccacaaaattttctcaagcttcctgttcatatctgcatttaagaaaaaattaaatagtaataaaatcaaataaactgaacaaatagaagaaaaattagggaatagaaacagaagaaaaactgtaattcattttgcctgaaaatgagaataaaaatgtattctaaagactgtttttcatgttttatgtaaaaatgacagtttttaaagttttctaggggctgtctcttttaagatattagaacatagtgatactttattttgaatagatgtattatggatgatacataaaaattagttataactatctattgacgatatattgtttactacaatagaataagaccacacctgagcctaaagaaagttctcagtttactataggtaaaatcttgctatgaaaggtgcacataaagattagaggctttctgtggtggaggggaaacactgctggctgcagaaaaaaatatctgacataacatttaaatttaaaagcacaaattattgacttagtatgttaacataaatgaataaatgtcttctaaatgctttgtcttttactaaattccagcattttattactaaaaggacacatatacaataagtagtaaatatgcctgatatattttaataatgtaactaatttcctttataaattagttatagttttaatactcttctttatgtgctctaagtggctccattggctaggttaatcattagaggatgactaaattgaaaaatctttctacaaataacgtggtgaataatgtcatcttccaccatcttatgctaatgtataactaattattatccattgctgccatttctgaattttacataatttgttcatttagtgtgagctatctaaaatatatatggatttcaaatatgtattttatgccatggataaagtttatctctcttattctgttttgtcctataactatttcaaagcaataacacctatatggtccagaacagatgtcattgcttgtggtctggaggtcatgaacattgctaagccacacaaaaaaatgattttgtgtgtgtgtgtgtgtggttgtgcacagtatctcatgcctgtaattccagcactttgagaagccgaggcaggtacatcatttgaggccaggagtttgaggccagcctgggcaacatggcgagaccccatttctacataaatacaaaaataagctgggcgtggtgacgcacacctgtagtcccagctactcagggggctgaggcatgagaatagcttaaacccaggaggcagaggttacagtgaaccaagattgcaccagtgcactccagcctgggtgacagagcgagactccatctaaaaaaaaaaaatgtattttacaaccatggcttacatgctgagacatatataatctctgatgaataatgtatcatgctaattttatttaaaatattaaaactcatattacaccactatcaaagtaataaaaaataaaggaaatcgggtattctgtatattgacacaatatattttgctatttattctgatggctgatatttaataatagaatgggtacaaaataacttggaaaattatacataatattacatatatataaattcagaaatgtcttgtctagctgtttgtgaaagctgtgaagcatatcttccatttccctgagtagtctgttggtggcctggacaagttcaccctcatcacagcttgacccctagcggctagaggacaaaccctttggcctggttccagttccccagaactctagcacacagtttgggatgtatgaagatgacatctgcggcctgatctccagcaggggaggagtccacactgtcaaaacatagagaaaggtatggtgatgaggaagctgggtacccctcccttctttagacctgactgaaaagcttattgcctgacagctgtggtttctgctgcaggaaatctcaccatcgagatgcctagaatagctttgtgatctgggcacaaatggttttgggtcagactaacttgtagggccagttgccagagtggatgccagagggagactcaccaataagagggtgtatgagttggctcttcctctgagccagctctgtggtgcaggagaggcacctccaaccctttctggagggtcgtccatgaggcctgagagcttccactagacacctgctaaggttggtacttgcacctgcctcagagagcctggctgccagctcaccagacccagtgccgcacagctttgccctctcaagccaccttagtggcagagcacaggatggaaaccctgagagtccaggcactgcccatcaccagaaatatcccagtactactcctgatcaacaaaggctatgtaaaaattccactgccaccaccacaattacctcttgcctggaagtatcatctactggctaggaggtcaaactgcatggcccatcacaactgctgaaaccagtttataccatttaactggcttttagccaaaattgtcacctacttgctggtagggtgagctgcacaacccaacataattcttgcttacagcagtgtgcagtgctagggaactagatatgcaacccaagccctgtacctcaccatctctgtaggagacagtgagcctgaccacatacacagcatattgctaccacaacccacaaaaaaactagcacttaagaaaacctacactactatactacactcaggctatctataaccaaggaatttatacagagccttggccccataaacgcaaagcaaaggactctacctgacatgtgcaacagtcacactctcaaggaggaagaaaaaagtcatgtaaatgaaagttaatttaaaaataataaatgacagcatctacatatgaaaagaaaccagtccaagaactccagtacaacaaaataacggatattatgacacatgttatggaccatcctggcttcctagcaatggatcataaccaaaatcaaaacattgaaatgaccaaattcaaacaaagaatttaagatatgcattgtaagtaatctcagtgagattcaagagaaggttaaaaaccaactcaaagaaagtggaataacaattcatgagataaaagacaaaatagatatattttttaaataactggaaataaaaaaaaactgaagaaaatttaaaacacagctgaaagctttaacagtagagtagaaaaaagcagaagaatttcagagcttgaataccagtctttcaaatcaatatggtcagaaaaaaacagtaacaaaaaggatttcagaaagcaaacaaaggctttgaaaaatatgggttatgtaaagcgaccaaatctacggcttataggcattaatgagagagaactagtaaaactatgaaaaacataattgagaaaataattgaggaaaatttccccaatcttgctagagatgtagacattcaaatacaataaatttagagaatacctggaatatattatacagaatgtacattaccaaggcatacagtcataagattatacaaagtcaacatgaaagaactaatcttaaaggaagctagagagaagtatcaaatcatctgaatgaagaaaatgccatcagactacagcagacttcctagaggaagccagagattgaggccctatttttagcctccttaaaaaaaaaaaaagccaagaattttatatcctgccaaattaagcatcataaacgaagaaaaaataaagtctttcccagtgaggaaacactaagggaatttcttccagattggacctataagaaatgctcaaaagagttctaaacatggaaataaaaggacaatactctccatcataaaagcatatataagaaagctcacacattacacaaagcaattacacaattgagactccaaggttactagctaacaaaactataacaggaataaaatgaaacctcacatatcaatattaacattccagttaaatacccttgaacttaaatattaataattctacttaaatattaaccatgtacataaatagcctaaacattctacattccagaataatatattctggaagaacatatttatatattctggaagaacgtatttatatattctggaagaacgtatttatatattctggaagaacgtatttatatattctggaagaatgtatttatatattctttatatattctagaagaatatatttatatattctagaagaatatatttatatattctagaagaatatatttatatattctagaagaatatatttatatattctagaagaatatatttatatattctagaagaatatatttatatattctagaagaatatatttatatattctttatatattctagaagaatatatatatatatctatctccaactgtcggctgcctatgagagaacctatagggggtctaatggctagacacatatatactcaaagtaaaggggtagtaaaagatatagcacacaaatggaaaacaaaagtctgaatgactagccattcttatattaaacagacttcaaagaaacaacagttaaaaacattaacaaagaatggcattatataatgataaaggtttcaatacaacaagaatatttaactattctaaatatatacatgcatccaataccagagcacccaggtttataaaacaatttctacttaacctaagaaaagagattaatagcaatacaatattaattgggaacttcaacacctcactgacaacactaaacagctaatcgaagtacaaagtaaacaaaccctgacttaaactatactctaaactatgtggtcctaatagacatttacagaacattccactgaacaaccagagggaatacatttttctcatctacacatggaacatttgaccatatgcttggtcataaagcatctctataaattcaaaaaatcaaaatcacatgaagtattttctcagattagagcagaataaaagtaaaaatcattaccaagaagaactctcaaaaccacataagtacatataaacaaaacaatttgctcctgaatgactttcaggtaaacaataaaattaaggaagaaatccaaaagttttgaaacaaagaaaaatggaaacacaacataccaaaacctctgtgatatagcaaaagctgtgataacactaaagctaattgtgttaagtccctacatcaaaaagagaagaatctcaatttaaaatcctaatgtcacatctcaaggaactagaaaagcaagaggaaacaaagtcaaagctcgcagaagaaaagaaataacagatatcagaagagaattaaatgattctgagacttaaaaatgatacaaaagatcaacaaaatgaaaagttgtttattggaaaggataaacaaaatcaatagactgctagatagtttaaccaaaaaaagacagaagactcagataagcacaatcataaatgataaaggtgacatcacatctgatacatgccacagaaatagaaaagatcaccaaagattagtgtgaacatcagctgtatgtgcacaaactagaaaacttaaaggatgtaaataattcctggaaacatacaacctccgaaaattgaaccaagcagaaatgtaaatcctgaacagaccaataatgagtaataaaattgaatcaattaaaaaaaaaattataaaaataagcccaggaccaacagattcagagctgatttttaccagatgcacaaacaagagctgctaccaatcttactgcaactattccaaaaatttgggaagggattcctccctaactcattctctgaaacaagtatcactgtaatactaaaatcatgcaatgacaacaccaaaaataactacagaccattatctctgacgaacatggatgtaaaaatcctcaacaaaatgcaagtaaactgaatctgacatcaaaaagatgattcatcatagtcaagtgggttttattccagggatataagggcaattcaacatttgcaaatcaatgaatgtgatccaccacatacaccaaattaaaaacgaaaaccatttgattgtcttaatagattcagaaaaagtatttgataaaatccaacatttcttcaagatgaaaaccctcaacaaactagcaattgaaggaaaatacatcaaaataataagagccatatgtgacaaacccacaggtaacaatctgctcaatggggaaaagttgaaagcattccccctaagaactggaccaagaaaaggatgttccctctcaaaaatactattcaacatagtagttgaattcgtagctagagcaatcaggcaaggaaaataaataaaaggcatccaaattagagaacaggaagtcaaattatctctattcactgatggcatggttttataactagaaccccctaataactccaaagtagtactagagttgatacataaaggcagtaaagtttcaagattcaaaatcaatgtacaaaagtcagtagcatttccatacactaatgacattcgagctgagaaccatataaaaaactcaatcctgtttaaaatagccacatgcacaaacaaaaaatacctaggaatacacttaaagaattaagtggaagatctctacaagaagaactaaaagacactgatgaaaaaaaaaaattgtagatgacacaacaaattaaaagacatctcatgttcatggattggaagaattgatattgttaaaagtaccatagtgcccaaagcagtctacagattgaatgcaattcctatcaagtagcaatgtcattcttcacaggattagagaaagcaattgtaaaattcatatgaaaccacacaagagcctaaatagcaaaaacaatcctaaactaaaagaacaaagccggagacatcacattacctgacgataacacatactacaagggtatacgaaccaaaagatcaagtactgatataaaaataaacacatagatcagtagaaaagtgtagacaacctaaaagtaaagccacatacctacagcaaactgatctttgacaaagtcaacaaaaataaacaatagggaaaggactccccatttaaaaaatggtgatggaaaaattggctagtctacgtataacaatgaaactggactatcactaacagtatatacaaattaactcaagatgtattaaagatctgaatgtaaggcctgaaactatagaagtcctagaagaaaacctaggaaaaccacattggcctaagcaaagactttatgactactaccctaaaagcaaatgcaacataaacaaaaatagataactgggaattaaactgaaaagcttctacctaacaaaagaaataattaataaagtatatagaccacctgcagaatgggagaaagtatttgcaaattatgtcaaaccaacaatcccattaaaaagtggacaaaggaaatgaaaagacatgtctcaaaagaagacatacaagtacctatcaaacatatgaaaaatgctcaacatcacgaatcatcagagaaatgcaaattaaaccaaattgagaaatcttataccagtcagaatgggtattattaaaatgtgcataaacaacagattttgacaaggatgtggagagaagaagggaacacttataaacagttgagggaaagtaaattaatataacttctatggaaaatagtgtggggatgtatcaaagaactaaaactacaactaccatttgatccagcaatattacttcaggtcatctacacaaaggaaaagaaatcattatctcaaaaagatacctgcacttgtctgtttattgcagagctgttcaccagagcaaagtcacggaatcaagctatgtgtccatcaatggttgattggataaagaaaatgttatatatctaaaccatgaatactattcagccataaaaggaatgaagtcatttcctttgctgcaacatggatagagctggaggccattatcctaaatgaataacttacaaacagaaaaatcagtaccacaccttctcacttatgagtgggagctaaacaatgggaacataaagatggaaataatagacaccagtgatgcccaaagtggatatggttggaggggattgatgcttaaaaaattacctactgggtaatgtccaatattggatgatgaatatactaaaagcccaaacctcacccttatgcaatacattcaagtcacaaacctactcacgtgcatcctgaataaaataatattgtaagatatattactcataattcctcaaaaataggacttaaacataaaacataagcccaacaggttgaaaatacttgcaaatacaataataatctacaactaatttgatgttattccagtgccttactgaatggcatcagggcttctgaaagtaagccctatttttgtttcctgaagcactttaaggtaagattgtcttttaatatgcaaaataataaaaataattttgatagttttcacaaaatggttgtgaggaataaatcaggtagtaaaatgtaatagcagcaaagcccagtgtgtggggaagtttttttttttaatttttacttcctatgtatatttattactggactctcagtaaactgaactaatcatagtacttgaaaaaactccaagctttctgctatattaaaagaaaaaatatgtgagaatgaaacaattatttgctccacaaatcaggatttattaataccatttttatcccccacttaatgatcccccacttaatatagagtaatataaacacaacaaggaatgtttattttcatatccttgagccctcagcttgattttctggcccaatttaatgttttatgcatttgttaatctgaaaatattatttaatatgtattatgtgtcaggcactgttataggcactggaaagagtttctaagatgatggaacatacatgtttgtggggatgacatagaacccaaaacatataacatatactttcaggtggaggaagtgcaatgcgttacaagaaagcctgctaagctttctgagggttactggagggagcattgtacatactatggtcagggatcaccaatctaaggagctaacaatttcagagacctaagtaatgttgaaggaagtagccatgtggagatatgggagaagtgcattacagacaaagggaacaacacatataaaagccccaggtgggaaataggttgactttaagagagtaagaaagtctgtattgcatccagcacaatgaacagagaggaacagttaggagaagagaaataagagcagtgggaagtaatgaaaacatgtagagcattttaactttgtacagagactgtagttgagagttgacaaaatattaaattaatagtgaaatggatcaaattaatgacagctgagaagaaaaggaaaacagtgatatatgttaccaaacatgaaatgtccaaaacatgaagacataaacacaggcataggattgaattctaaaattttaaagtgctttagaattgacaaattacatgcgaatgcgtaatatgctaagtctcatgagtttcacaggcataatgtttcagtcttgactcttgtgaaacagtgtttgttggagttgattacatgggaactttcccattggaatcctatttgtctctttttccttagggggtttaaataatgacagaatagaggaaagtctgaatcatggcagaattatcttcccacttacatatgaaggcataatatctggtaaaattgattttggccaatgatgacgtttaataatttcatttaagataaaaaggataattttcaaacaattaaaacaaagactgcagttactatgctcactggaaaatagcctcatattattaaatcaattggcatgatctcagttgtggaaagcttggaaggggacagcagcgttgtaagtacatggcaaagaaaataaataatagtgtattatagaggaaaaccacatgaaaggaatcatgaataaaaagataatgggggtaaatttaaatgtaactgacaattgcaaaaatagaaaatcacttgtagcatgaagaacgtagataattttataatatatttaatgagattttaaatttctcagtgttaagttttagacaaagttttaaaataaatattttataattcttgattataatggcctcttgactagcaagtccctgcatgcagcctttcctgatgttttaatttacctataaagtcgtacaaacacacacacacacacacacacacacgaagcaaacgaacatggttactgaaaagtgagagataaatatactagtcagtgtctaactggaaaaacacaaactattcctaggtaattttaagaggaaatgtaaaatggggaagtgtttacacgagtattagcgatattaaatcctgaattaaccaaatataaaaacttcaagaaaacctattactcttacagatgggagaataggagaagtattggagttacaggaaccttgaagttcagagaagtaccacaaattgaatattcatatctcctaggaaagggcttgtgttggtgctgctgatacctttaagcatctctattattttcatattctaacaggaagtcacttggtaaaagaatctgaaaaatgtagtttgtagaatcccaaccaaaactgctatcacagagaaaaatatagaagactagctttctatctgagacataacatgcaaaccatctattggcatactgttagaaaaaattttgatggaacaggactgttaagagactgtaggtcttactttataaataaaaacaagacaaaagctttatatatatattctctgactcttctctaactctgaggtataagatatagtcatccaaagtactgactttctaactctgattttcaaccaaatattcttgcatctatccatacccatttagagagagaaatttccagaaatcagaggagcagacaggtagagtatgacttgtccttgtgaattgtgttctggtaaacagagtagagagaaaggaatatctgtaggaggggcagaaaaaaaagcccctatagctatccaaacttaggattattatttttgtgtgtgtactccaaggtacacacaccaaaactagaatgagaggactattaattcactctgtcttccatatgagaataggctcgaatatcactcagaggaaacccaaagtaggttaaaatttcatccatatatgaagtcttttgggtgaggtaaaggcataatagatcttagcatctaaattatggacaaataagtacaaaattgaacaccactgtgattatggaaaacaccattgtgtttactgtgaagcaaggaaaacaaaacatagacatagagattcagaaaattatttatgccagaaaaaaaaaatttaaaagtcaccaaatagtgtgaaacaaatacataagaaaggctggaaataaagttttgtaataatgccattaaaatggatggagatgggaattttatcaagtatgtggacaatttgagtactatacaagaatacaaacaaaatgatgagagataaactgacaattggaaaagaaagaatatggtggtctaacataagaatgaaaggtattttccaggaagaaattaagaattgaaacagaggaagtaatcagataaaattttttctttaagaagaaaatagaagatatctgggatctatacagctgaatctaatattttaattacagctaaagaaagcttgatactttttggcccactgttttcttaatatattcaatgaactttctcatatgttagccactagttatgtgttactatttaaacataaattttaattgatctaaattaaatacaatttaaaaataaatttgtcagtctgagtagtcacatttcaagggcttaatagccagagttgccagtggctactgaattatataatacagatatagaacacattgattactacagaaagacctactagacagtgctgttctaagaaattatttttagaaaataaggagagatgctcttgaaaatttatgtataagaagagttatcttaagaggacatgttaaaaaattcattaatattgtactactcaaataagttatattcataaaaattataaagcatttaaacctataatttagaaaataaatttatcacactagacaacattcttatgataatatgtaaaaatatattaataattaattgagatgctttcaattttggacaagtaaatggggcttatattttatgtaattttaatatataaaatcgatcgatgttcgttacatttaagtggcaggattattcaactgtttttctttatttttttttcctttgatgtagaggaattatttatagtgaggcatgttattttatagtcagaaacacttcttttaaacaaaattagcatatatttgcatgtgatgctgataaactgaacaaaatatgtgacattacttaaaatagaattttgagatggagagggtgctgctcatggaaaagtggttctgacagaatcgatgaactgtcatccgtgtgcgcacctgcggcaactctgctggaggcttttagctgaatcccagcggtgaccttcaaagttgtttttaggtatttgcattaaaattttgagaaaaacgttcctttgtttttacaatacagacatgccttgttttattattctttgcttaattgtgccttgcagatgctgagtttttgaacaaatggaatgtttgtggaaaccctgcactgagcatgtattggcttttccaacagcatatgctcacttcatgtctctgtgtgacggctgggcaattctcacaatatttcaaacttttcattattattttatctgttatgatgctctgtgttcagcgatctcttatgttactaatggaattgtctcaaattgccacaaactacaaccacataagtcagataacttaattgctaaatgttgtgtatgtcattactgttccaccaaccacccattcatctgtttctctgcctctcctcaggcctattctatgagacacaacaatagtaaaattaggttaagtaataatcctacatggcctttaagtgttcaagtgaaaggaagagtagtgcacctctcaggttaaatcaaaagctagaaataattaagcatggtgaggaagggatactgaaagctggccgggcgtggtggctcacgcctgtaaccccagcactttgggaggccgaggcaggcagatgacgaggtcaggagacagagaccatcctggctaacatggtgaaatcccgtccgtactaaaatataaaaaattagctgggcatggtggcgggtgcctgtagtcccagctactcgggagtctgaggcaggagaatggtgtggacccgggaggtggagcttgcagtgagccgagattgcgccactgcactccagcctgggcgacagagcaagactccgtctcaaaaaaaaaaaaaaaaaaaaaaaaaaaaaagcaagcaagctgatataggctgaaaaagttaggcctcttgtaccaagcagccaagttgtgaatttaaagaaaaatttggtgaaagaaattaaaagtgttacttcagtgatacaaggaatgataagatagtgaaacacccttattactgatatggagaaagtttttaacagtctgtataaaatattaaaacagtcacaacattcccttattaaaaagcctaacccagggcaaggccctaagtgtcttcaattcagggaaggcgggagagaggtgaggaagctacagaagaaaagttcgaaggtagcagaagttggatcttaaggtttaaggaaagaacccatccccattaatagaaaagtgcaaggtgaagttgcaagtgctgagtagaagttgtgacaagctatccaggaaaactacctgagatcactgctgagggtaactacactaaacaacaaatgttcaacgtagacaaaaaagccttatattggaaaaagacatcatctaagattttcacagctatggaggagacatcatagactaaattcaaagcttcaaatcacaggctgactcttgttagaggccaatgcagctgatgactaaattgaagccaatttgaagccaattcagaataccgttctgaaaaccctgggggccttgaagaaatatgttatttctactctgcttgtgcactataaatggaacaagtcctggatgatggcacgtctggttacaggatggtttactcaatattttaagcccactgttgagaactgctggtgagaaaaaaagactcctttcaaaatattactgttaatatacaaagtacctgcttacccaagagatctgatgaagaggtgaaaggagattaatattgttttcatccctgctaacataacattcattctgcagtccatagaaaaaggagtaattataactttcaatattattaagaaatacattttataaggctatagataccatagatagtgattccacttatggatcttggcatattgaaacattctggaaaggattcaccattctagatgccattaagaatgtgtggttcatgggaggaggtcaaattatcaatattaacaggagtttaaaagaggttaatttcaatcattatgaatcattttaaggtgttcaggcttcggtggaagaaggaaatacaaatacggtagaaataacaagagaactagaattagaagaagggcctaaagatgcgattgaactgctgcaatctcatgataaaacttgtatagataaggagttctttatgaaggagcaaataaaatggtttcttaagatggaatgtacttcttgtgaaggtgctgtgaacattgttgaaataacaacaaattatttaaaatcttacaaaaacttagttcatgaaaccatggcaggcttaaagggaattgccttaaattttgaaagaagctccactgtgggtaaaacgctgtcaaacagcaacacatgccacagagaaatcttgtgtaaaaggaactgtgcaccgatgtggtaaatttcattgttgtgttatgttaagatttggcacagtctctttagcattcagcaaccaccatcctgatagccagcagccatcaacattgagacaagaccctccacaagctaaaagactatgacttgctgaaggttcagatgattgttagcatattttaacaatgaagaatttttcagttaagctatacatactgtttttgtagatataatattactgtggacttaacagaatatagtatactttaaacataactttatatgcactagagaacaaaaatattttattgcagtggtctagaaccaaacctgtaatttcaatgtaagtcttcacagtgttcttttgtcagcatggtacacaaagatgtacttacatataaagtgttctaatttttcatataaattgtaaataaatgtggcaaatgttcacagttcttaaattaaggacaaaagcaaatattatataattaagttcatcttttgttcatgtttatatatttatattttatatatgcatagtaatttctttttgaggtttgtcttaaatgagtaaaaagtgtttacatgagtgaagtgtgggttctgtacacgtctatatgactaatgttcaaattgtatgaatacccatacatatataagttatttatagtgtgaatatatgcattgtatcatgaaatatgaataagtttataatccatgctataaaatgatacaaattgtattactactttatagcattaatgtacacaaatatatttaatttaccaaaaatataaggtaaaagtaaataatatttttgtgaattttgaaacattgtggtgtgagaagcactagtttgctattgtggttaaggcacatttttatattagaatatattgagtttaaaaatagtacagaatgtttaacatattagcagtaatttctaggaaaaacctttatgaagtttagtataaatagaatataaaaaataattttaaaatgatgtgatcagtcatcaaaagcatctgatatataaacaataaaaacacaatcttaaactgttataatttacttggcttgcaaatattttataatataatatgtatacatatattatacatcaaaatttatttttgatgatatgcttttagtaacttattcctatgacaaatttggcaagtaaaaatcaaaattattatctaattccattaacatgcaaaacatatcacaaaattagtgaaaacctaatttgaataagcccacatttaaatgagaattgctaggtcatactaatcaattaatcaacctctcaatctagaatgtattgaacaaatgagcctcagcaatactgcttaatacttatggtccattaagcaagaccaggtgaatgaggcaatcaaaatattttaatagtgtatccgatcaggagatagtagaatactaaatgatctggtggttatttttaacaatatgttgtgctcttgagaagtaaatgaatcttggaggattgtcagctggaatccaaactcaatgtatcattttaaacagtcacttaatttcttgattgttttaacctgaataaatttaagactgtagcaattttagacaattatccaaatctaatgtctatggtcatttcattccatgaagatgaagtattatgtatagcaatgcttttttcaaagaaaaatgaattatacattagaaattatatgatcacttataataaggtattaaacaatgagaaatttactgtaaagatggcctagcattctaaaaaatgccaataaatatttgtcaaacactcttctagttgctcatttttagggatgatcaaaacagacctgaaaccagatgatgagacgggctggagcaaaggaagggagctcctttaattagggtaatcacagaaggcatttttgaggaagtaatagttctgttgacatataggaaataagcaggaatgcaatgaaaagagccatatgaaaagccttttagtctgaaagaataagaaatgcaaacgatctttatgagcatggagctagggatgtcaaagtgtaaaaataaaccagaagctggaaagataggccaaatacagaaaatatagagttttctgggatgtggtcagaagtttagatgtcatgctaaggacactgacatgccagtaggttaaaaatattatctgatttaaatatacactaaaaatattctgacttgctgtgtggagattgaagagtagaagcaagagtagaagcactgagaccaactatgaaaggttttacattgtctccattgagagatcttggtaacctttactgaggatgtcacagctgaattagataatagtggataagttcagtttatatttttaaatagaataaactagatctgggggctatgtgtgtggtagttgagtaagagaaaggaattaaacaagtatcttaatattttcctttagtaattaggtaaattgaaaatactaagagaagataaatgaacattagatagtatgggggatagttataaagcagaaagtgttttatttctgacttttgtatttaattcatctcttaaacataccctgatagggatacataagaccaacttctaaataagtcaattacaggaaaaaaaatttagttattggcatgcagatggtatgaagcatatttgatgctaacattttttctttacctccctggttttgtgatacctcactgaggtaagaatgtgttttttgaatgtatgattttggttttggatatgtgagtttcttcagcaaaacaaaaacaaaacatgagtagagatgacaatgtaccagttgtaagctgaggctttattagacatcaaatattttcactcattgggattttgccatttgtcatgagaagagcatactctgggtacctgttgatcctgaaatgaaaaacacatgaatcagacttcaacctagtcccaggcctaagtctttactctagccactcaagatttgtgagaaagacaaatcgttacagttctaaatcaccaaacttcagatgtctcaccagaaatactgttaaatatgtgtcatataaacaatgaattctaaataaaatcatctagcctagaatggagaaaaaaattaaagaggaataaggagtagggcaatctatcttttgtggtcgggtagagaagagaaaagggtagaaaaatcttgcaaaataccaaggatccaaaatgaaaacaaagcaagtgaacagtgatagaaatcaagataacttttttttccaaaaagtaaaataagacaacttcagaatgctaatgagaggtggagaaaaatgaagacagagaagttatttctttattatgatctcagcaagccttaatttacatagaagatatatcttccaaattttgcatgatttgaagcacataaaatattttagggggctcataatcttcaagtaggtttatatggcatttaaatcaagaaacagtaaagctgtaatcatttctggagatgtttagacatataagcacacatacatatatttggatggtaggcatttgccaatacaggaaacatggttcatgctgccagatttgacaaagattaaaacaatggttccaaataaaccggaatgttgattttcagtagaggaaaaatagagaaaattggtgattggtaaaaccatacagaatagttcacaacctaaattatcttggtgattaaaatatagtagagtgtttgccaagtctgcttgtaaagatgctggagtattagcagctgaaaagaaaagataacattttcttctactgagtttagagaaactttttttcagactaagaaatgtagctttcaagtattaagaaatataccatgagatttacaatatttttttccttcatttgtgaagcactagacaaatctttgtttacatctgtttctgaattccagtgaaatgaaatagcacagaagtcaaaaacaataattgtattagtctgctctcatgctgctgataaagacatgcaagactgggtaatttataaagaaaaataggtttaatggactcacagttccatatggttggggaattctcacaatcatggtgggaggcaaaaggtacatcttacatggcggcaggcaagagagaatgagaaccaagagaaagaggaaatcccttaaaaaaccatcagatctcatgaggcttattcactaccatgagaacagtatggggaaaactgcccccatgattcaattatcttgcactgggtccctcccacaacacatgggaattatgggagctacaattcaagatgagatttgagggggaggcataaaggcaaaccatatcaataattgtatctttcttcctctcatctataagcctccatattgatgtgatataatcctatagccttgggaaaacctctctgcaaaactatttttttaaactttttataggctcagatttttgcatttttatccttattgtttacatcaaaaagactacttgcgatttttaatgactgtgattttatttttaaaagtatcaccaaatccagaaaaagaaatattggaaaaaaaaattcactcttcattaggtacatttttaccatgtacctaccatgcactagacactctgctaggtagtgagggtaacactgtgatgataaatgataatatggcttgaacccagtgggtggtaattgaaacatgagggcatgtttttctcatgatagtgaataagcctcatgagatttgatagtttataaagaaaaattccttgcacatgctctcctgcctgtcaccatgtaagatgtccctttgctcttccttcgtcttccaccatgattgtgaggtctccccagcatgcggaactgtgagtccattaagcctcttttctttataaattactcagtcttgagtatgtctttattagcaggatgagaatgaactaatatagtaaattggcaccagtagagtggggtgctgctgtaaagatacccaaaaatatggaagtgactttggaactgggtaacatgcagaggttggaacagtttggagggttcagaggaagacagaaagatgtgggaagagttggaacttctcagagacttgtggaatggttttgaccaaaatgctgacagtgatatggacaataaagtacaggttgaggtgctttgagatggagatgaggaacctgttggaaactggaataaaggtgactcttgctatattttagcaaagacactggtgacgttttaaccctaccctagagatttgtagaactttgaacttgagagagatgatttagggtatctggcagaagaaacttctaagcagcaaagtgttcaagaagtgacttgggtactgtaaaatcattcaattttatgtattcacaaagatatggtttggaattggaacttatatttaaaaggcaagtagagcataaaagttcataaactttgcagcccaatgatgcaatggaaaagaataacccattttctgaggagaaactcaagttggttgcagaaatttgcctaagtaatgaggagccaaatgttaatcaccaagacaatggggaaaatgccttcagggcatgtcagaggtcttcatagcagcccctcccatcacatgcccagaggcctaggaggaaaaaatggttttgtgttccaggcctagggccatgctgctttgcgcagtcttgggacttgatgccctatgtcccaggtgtggctaaaagggggcaacatagagctcaggccattgcttcagagggtgcaagctgcaagccttagaggcttacacatggttttgggcctgcaggtgcataaaagtcaagaattgagatttgcatagatttcaaaggatgtatggaaacacctggatatctgggcagaagtttgctgcaggggcagggccctcatggagaacctctgctaggtcagtgtggaagggaaatgtggagttggagcccccacacagagtgcccactggggcactgcctagtggagatgtgagaaaagggccactgtcctctagacccaagaatggtagatccactgacagcttgcaccatgcacctagaaaagacaagacacaaaatgccagcccatgaaagcagcttggaggggggctgtaccctgcaaagccacagaggcagagctgcctgaggccatcggaacccacctcttgcatcagggtgacctagatggaagaaatggagtcaaaggagatcattacgaagctttaagttttggctgccctgctggatttcagacttgcatgagacctgtagcccttccttttggccaatttctcccatttgaaatgggtatatttacctaatgcctgtacccccattatacctaggaagtaactaacttgcttttgatttttcagcattataggtggaagggacttgccttgtctcagatgagactttggacttggacttttgggttaaggctaaaatgaattaagactttggggaactgttagaagacatgattgattttgaaacttgagtgcatgagattttgcaggggccagaggcagactgatatggtttggctatgtcctgacccaaatctcaccttgaaatgtaataatccccatgtgtcttgggaggtacagagtgggaggcaattgaatcatgggggtgggattttccgctgtccttgtgatagtgaataagtctcatgagaactgatggttttataaaggggagtcccctgcacatgctctcttgcctgccatcatgtaagacatcccttcgcttttccttcatcttctgccatgattgtgaggcctcccagcatgtggaactgtgagtccattaaacctctttcctttataaattactcagtctcagtatgtctttattagtagcatgagaccagattaatacaaaagaacacagaatttggcctcatttaaccaaagtaaaacagaatcaaacggaaatataaccatgaaagttttacaaggatgcatatatagtgctaaggaatatgatatgcataattggcctactttgtgaagtcacaggatctttgctcaggaatcaacaatgattgagttacagagaaaaatctgaattagatacatgggatagcagagaaaagtggatttgtcaggaacgagaagatatcacagtaagaagaaacatggtggcaccagcttaaagaactaaaaacggtcagtttgtctggataacaaaacataacagaaaacacgtgaaataaggatgaagaagaagtaagagtcagggtacacagcaactcacaacagaacagctaaacggaagtgattaagagtacagacctaaggacgacatcaacaatgatggtaagaattccaaaattcagtccctctacaaaagcaatgataaatttaacaaaacctgtcagaatcaactgttttaaagctctggacctctaatcaaaacctcacaataaataggggaatgtatgatgatgaaagaaactgccgaccagcctgaccaacatggcaaaatcccatctctactaaacacaaaaaattagctgggcgtggtggtaggcgtctgtaatcccaactactcaggaggcttaagcaggagaatcacttgaacccaggtggcggagtttgcagtgagccgagatcatgccattgcactccagcctgggcaacagaatgagactccatctccaataacaacaacaagaacaagaacaacaacaacagaaactgccaaatattaacaagagaacatatgacattttaacttaccttctatcatcttccagtctctaacttagtgctatttgtggagataagtggtctatattcctagtgtgtctagcttgtgccagaggaggcaaaaatgactgttttcaaagacatatgatgtgtgttgatatgtttggtgggttgctgagggattggatctgaagtttgcctttattgagaatattgcctagaagtattctcagtctaagaacagcaccttatatcacatttggcaaaagcatttatagcaaagtacactaccacagtagtctaggacaatggataccatccaggtcaagtagcagacagatgaaaaagcctcggaaagaagagactggggaaggaaattggcaggctgcttttcagggtccctccactgtggtaccagttggtccaccacatataagactgtactcaacctgggcagctttcctgtcttggagtaccagctcacaatggatactaggctctgatctcccttgctgcatatctgtaagtaatacattcacttaaggtaacttgtacacgagtgtcctgtctcactagactcagacaagttggtaaccagtgcacaatgaagttgcttgacaagatgacttgagtaacactacaaaccagacctaacagacatgcacaggatagtccatccaacaacagcaaaataccaacaacaaaatacaaattcttattaagttcacatggaacatcctctatgtattaggccacagcagtctcaaaatattaaaaaaattgaagtcatacaaactatctttagggatcacaatgaaataagtatagataaaaggaacaaaaaagtagagttcataaatatgtgaaaattaaatgacacactcttaaccaatcagtcaaagcagcaatcacaaagtaaattctaaataaaaaaatatgttgagacaaatgaaaaagatatacagtatgccaaaacttacagactgcggtaaaggagtacttggaagaaatttctatcaataagtacctacattataaaagaagaaatatctcaaatcaacaacctaatgttacaccttaaggaatcagaaaaatagcaaactaaacatgaaactgaaaggaagaaaataataaagattagagtggagataaatgaaatcaagaaatgaaatacgatagagagaatcaacaaaactaaaagttggttctttgaattgacaaacctttagctagattgactaaaaaaaacagcaggagagaatactcaaatcactaaaattagaaatgaaattgcagatggggacattactgctattttaacagaaataaaaggataaaaggatttataagaatactaaggaatacttagttctatgccaataatttatataaccaaaacaaactggacaaattcttgaaaaaatacaaactaccaaaaatgagtcaggaagaaatgcaaaatctgtccggacttaccataggtaaagtgattgaattcgtagtcaaaacctccccaaaaagaaaacacaagacgagatggccacactgacaaattctatgaacatttaaagaaagtttttcagataatatcagaaattttcagataatatcaatttttctcaaatagaagatgaaagaatactttctagctcattctgtgaggaaagtgttacccttaataccaaagtcaaacaaaaggaacaaaaattatacaccaatatatcttatggatatagttagaaaacttttcaatatatgtataatatatagaaaaatacagagaattgaaatataataatcaacaaaactaagtctaaaaacttttacaagaaaactaaaaactaattataatgtattgaaaatatttgaatctataatataatatataattataattatatagtatagcaaatataaagcagcatattaaaaatggtaaaaacattgtataccctcaccaagggggatgtatcccagaaatgcaaggagtttcaacatagaaaaccaatccacataggctgggcacggtggctcacgcctgtaatcccagcactttgggaggtcgaggcgggcagatcatgaggtcagaagttagagaccagcctggccaacatggtgaaaccccatctctgctaaaaattcaaaaattggccaggcatggtggtgggcatctgtaatcccagctactcgggaggctgaggcaggagaattgcttgaacctgggaggtggaggttgcagtgagccaagattgtgccattgcactccagcctgggtaactagagcaaaaaactccatcaaaaaagaaaaaaaaaaaaaaggaaaagaaaaccaatccacgtaactttaattgaaagagaccaaaaaactacatgatcaactcaattgatgaagaaaaaaataagatttgcaaaaatccaatgcacttttgtaataaaaacactcaagaaactacgaatacaagggaacttctttaacatgataaagagcatttgtgaaaacccacaaatatattatattcaataacaaaagatggaaagttttacctttaatatcaggaactagacagagaaatctgtttttaccactacactggaagtttaagacagaaaactatgcaagaaaaacaaagatatctctattagaaataaaaattaaatctatttatatttaaagacttcatgatgttatatataggaaattcttaagaatagtaaaaaaatctattagcattaatatgcaaattcaacatggttgtagaatacatatcaacacactaaaatcaattgtgtacgtatataccagccataaacaaatttttaaaaattaaaatctcaattccattgcaagaacatataaaacatttaaatatttagaaataaacttaatcaatgaataaactaaccaagaaggtgtaaggctcttacactctaaactgcagaatattactgaaaaaaaattaaaaaactaaataaatgaaaatacatcctgtgctcataatggactcattaactcaacaaaaagacaagcaaccaatttaaaaatggacaagggacttgaacggacatttctctaaagaaaatagtaaacaaatacataaaaatatacccaatatcaattgtcaatacggaaatccaaatcaaagccacagtgagatccacttcatcctgagtagaacaacaacaaccataaaaacctgagaaaaaacaagtatcattgaggctgtggaaacattatgaccttcatatattgtttatagaagtatgaaatagcgagaccgctgtggaaaagaatgttagttcctaaataagttaaaaatagaattactgtatgacccaagaattttattccttggtataaactcaaaagagttaatagtagttgttcaaatcaatacttttatacaaatttagtagtgctcttcacagtagtcaaaaggtagaaacgcagtcatccaaatatccatcggatgataaatagacaaaatgtggcataacaaacaatggaatattattcagttataaaagcaaaataagtggcctagtgcagtggctcacgcctgtaatcccagcactttgggaggccgaggcctgtggatcacctgagatcgggagtgagagaccagcctgatcaaaatagagaatcccatctctactaaatatacaaaattagctgggtgtggtggtgcatgtctgtaatcccagctactcgggaggctgaggggaaaaacaacaacaacaaccaaaaaaaaaaaaaaacaagaagtactgatacatgttgcaacatgaaagaatttcgaatgtgaatatgacatattttctgaattattccacaatatatgacatgtccagagtatgcaaattcagagatggaaagaagtttaatgattacaaggggctgagaagtaacagttaattgggtatgagttttctttgtgaggtgataaaacagaagacaccagtttatgtctattaggagggctattatttaaaaatacacatataagaacatgaaataattagaattatctgcactgcttgtggaagtataaaacgataaagccactgtagaaaatgatatggcagttcctcagaatattaagacataaaattgatgtatgatcatattgatatatgatcaagcaattctacttctaggtataaataaacgaattgaaagcaggaactcaaacaggtatcttaacactaatgtttataggagcattattaataatagacaaaagcttaaatatctgaaatatccatacattgatgaatgaataaacaaaatgtggtatagccataaaatggaatattattcaatcttaaaaaatgaaattatgatacatgatacagcataaatgaacttagacaacattatgctaattgaaataagccagacaaaaaaaggacagatattgtttgattctacttatataatgtataaattgaaattcatagagacagaaaatagaagagtggttaccagaggctgtgggaagggggaaataggcgactattgtttagtgggtagggagtttcagtttgggatgattaaaaagttctagtaaggaataaggatgatggtcacataacaacgtgaatatatttaatactactgaattatatgttttaaaatgggttaaaatgttaagtttgatgttacatatattttaacacaattttcaaaaatagatgcatccataaaaagtctatagctagcgcagtctatgtggaaacaaggatatccactttctccatttccatgcaacatcgtactggaggtttttaaatggtgaaataagacaaggaaaatacagaaaaagcactcagattgaaaaggaaaaaataaaagtattgactaatgacataattgtctatgtggaatatcctactaaatctattaaaaatactgaaactattacatgtgttccacatggttataatatttcagtaacattaaatatatagtaaatctgacaaaaatatgcaagacctacacatttaaaacttcaaaagactgttgacagaaattaaagaatatctaaataaatagatatattgtggtcatggatcattaataatacttttcctcttttacactattggcttttctctaacaatttgatcctaacagcttttaatcatggtgaaaaccctaccatttgaatcaatactttcagatattaattctccacaaattgatctacagattaagtatagtcccagtgaaaatcctagcaggtattttatagaaataggcaagatggttttataaatcatgtgaaaatgctacgaaaaaaatagtaatacaattggagttctaacactctctgacttcgagacttgttataatgctgtagtaatcacaagagtggtggtattggtaagagagaaagacacacttgttaatgacacagaatacagaatctacaaataatctagttacatggtcaattaattttgacaacagtgtaaaggcgattcagtgggaaagagcattttatcaaatgatgctgggagaatcagattgttgtttcaaaaaaagaaagagccagtcttaatccataccttgcaagatatacaaaaattaagacaaaatggattatagacctaaaagtaaccataaggaaagaagattcttgagagtagacaaaattgagcaaagaaactggtagaagaaaaaccaagacaacacaatttcactgaagccaaataaacagaattgacttttaaaaagaaaagaatgcttcattggataatgctgaaatgttttaaaagattaagattagaaagtgtccagtgtatttagcaagatatggaccatttgaacaactagtgttgcggctagataaacaaaaaagaaaaagaaaaaaaggaagcaggttttagacagtaatttttagaaaacaactttttcgttgagcaagagatttatagggagacagcatagcaaggatgttgtttttgtttgtgttatataacagtagagaactgagcatggaacaaaaaagagcttttggtcctaaagctcttaggaccaaattggtggagaaaagtcaattgtatagaaaataacatgtactattaataaacgaagttacagaaaaaaaaaagtggcagaatccggagccctttcgggaaattagacagaaagaaggttctctaatgtaagagaagacaagagtgcagatgggtgtggttttagattgaaagaagagagagaagttcatggatagtgagtttatactctttctaagactggagctgggtggcaagttgcagaaatcagaggagggtgaagaaaagtgaaaaaacataatgttgaagaaagtgacaatgagtgaaactgagaagtctcaagtgtgatatctggacagtttgctgtgtccattttagatatgagatgttgcatttactgcaagacaattctcctttattgtgaggtaatacagttttgtgtaattgcccagttgaagaagcagaataaagtgcacatgggtcttgccagagatctatgacacatacataaataatccacgggtcttaggggaatgtttctaaaataatcaaccatttaagtaataaggggaaatgaaaagaaaacaatggctgacagactgttagaaagtataggggtcaatgaactatgaaaagtgaatatttatacaataaccacttgagtaataaagggtagaatccatcacagacagcttgcagtttaaacaactgttcttctaataacacaatagaagtaatctaaagataaattaagtgatcaaatccttaacagaaggagtcacatttcttgccattttttactttcatgtgattttctcctagattacactgtgttttgttccataactggacagattttaaaatccaataaagaaaaaaataaaaataattggcgaatagcagagcatccagaatgattggtccaggtttagcaaccatctatgaggtcaatgtgttaatacaattacccatgtataatacaattattcatgcatacaattagttttccccccagaagattatttttatacaatgccatacattttaatacctctttttaactttaatatgagttgctaatcctcgtcccttaaaaatgttttcagagagaaaaatttactgtcttggttaaatgcaattatcaacaatgcaaaatttattttcatgtcttttttttcctagagagtctgtatttgaacaatgggcctatctcacatgtggagggcctcccctcatttttcacatactcctgagttacaacgttgacaattatttttctttgagtcatatcttttttcagagagtaaggcctgaaatttgtctggaatatccctcttttatatgagtagaaattttaaaatttgcagtagtaatatgcatgtcaaagctatcattgttttgggaaaaaaatatttcattgtgttacatggcatgctcttaattgtacaggtgaagtgatgttttacttttactggcagtatttaagaaaaacaaaaagtgaatatatatttcatactaggcttaataactgggtgatacaataatctgtacaacaaacctccatgatactagtttacctatgtaacaaacctgcacttgtaccccaaaattaaaagtatatatatatgtacttttatatatatatatgtgtatatatatatacttttatatatatgtatttatatatatatacttttatatatatacttttatatatatacttttatatatatattttatatatatataaagaaaatatatatatattttcttttcagacatatatatctgaatttctgttgctttttaagcaataatatcctgcatatgattatttttggcttatttctctgtgtattagatcagaaaaaataaaatatataaaaatcacacaattgtgtatgaatatatgcatgtatttatttgaatgaaatccattcattaaaacagttaaattctaaaattgttctatgtcgctcaaattccctctctgtggtgttttattaaaagagaggattggggagagactctttacctaattatgaaataatacattgtgttggcagagaaaatcatcatgatggctcaaagccaataaagtctgtatcacagatttcagtttttttcaccttgaccataaatacacaaatggatgaacagcaaaggataaatgtgctatcaaggtttgagaaagttataggtacaggcaagtttttcttctggagtgttgcttaataattaaatttaataatgaaacattgatagatatcctcttagtgaaaatacatcatctcctttgaaagactccagtcatgggatatatttataattccttaaatccttagttaccgagaaatatgcaactatgcagtcatatgatttaaaaacaaaaggcactctaaatcaggagaaagcaagtagtggtatgaatagttcccaagtcttgtggttgaaaaagatataaaggcttctcctgagattaagctggaaaactcacatagcaattagtgaatccaatctatatgccagtgtaggcaatgccactattgtgtgcaagaccatatctaagtgtttatatttctttttaaaatgttctatatttatctataaaatacactatgtaagtaaaaaagcaggtctgtagaagatatgatacattatattatatacagtttcttcagccttctcttttctgaagttccaagagacatattcctaatcagtccaagttgcatatgtctatgtttatgtctctgtatttgtgcaccattgcatggtggagctaccagaactgtgggtgcagatataatgtccaaaattaaaatataaatccttactacatgactacagagaagaaaaaagtaatatttgatttcccatcaaatcacgcatgtggtactttcggagaacaaatattgcctaaaaccactgtgatctactgtattaatggactcctcaaaagtgactactttcttataattaatctttcaattattttccaaaattcttaaagtccaaatttcttaacatgctctataataataaggataaaatctttttttatgcctcagtctcatgcttaaacgtttgagtagttttagatttgctgaaaagttacaaagattgcaccgagttcccatatacccctcacccagtttctcctcttattaacagcttaagatctggcatttgtcacaattaatgaaaatagtgatttattaactgaagtccatacttgatttagcttctgtttttacctaatgcctgttttcattcccatatagaatacattatactatttccaaattaggtcatattctaaggtactggaagttagaacttcaacatatgaatttgggtggggagtgataatttgacccataataaccctcaaggttctaggcaatcactaatcaacttataaactgcctattctagacttttcatataaatggaatattatagatactgtgactttttcacttagcatgttttcaagatccatcaatattgtcacatgtgtcagtactattagtctgctcctgtgaatttttcatttcagttcattaaagaatttcctttgtatttcttatatctgtatcttattgatattctccatttgatatgaaattgtcatcatgccatcctttatttaatcttagtgtcctttaattctttgagcatgtttttaagagctgctttgaagtcttttttggctaaatttaccatgtaggccccatcaaagacagtttttcttgtttgctttttcactgtgtatgggtcatattttcttgtttctttgcatgtgtcatatatttctgttgcaagtgggatattttcggtaatatgttgtagcacctatgaatacattacccacccctccatctggcagtggttattattgctgccgtttgcttggtcatttgtttgcatagtgatttgactgaattaactctgtgagggatattttccttgcagtgttttccctgatcatattttccccttatttttaatctttgagtctaatatctagaggttgtcccaggaagaatatagctatttattgttgaaacattttgcataagctctccttagccagttggagttttacccttttactgttggatatgtgtgtgtggcttggaggctgcaatcattatttagggagtttatgtcagtctcacattcaacagactgccagcttggaggttccttctcttattgtactttaaagggtgcagccttgttgggcatgtacagtcttccagaaagctgaggataagtgttattttatctttacgtttagcttctctagtagctacctccatgtcagaataattaactgttcagtcactgttttgctagaagttgtgtttaagctccttgtgtctatgaggtttctaccctgtgttgatgggtctgcatgtagcttggagaatgttttcattttcatgccttgacctgctcagattgctcctgagtgagggcaacccagcacatgcacacagccttccagaagccctgagttgactgtgatctccaaagggacatcctgggctgtctctcttcctgattctatcacatttccggctgctctgttgttctgtgtatattatgggtctactagcctcttcttagtcactgcccaccaagatcttcattatttattaatagtgtccttaggcatggaattctatgctttttgtaccaagtaaacccagtcatctcagacaaatctgcagagctctttgtcatacggccagcctctcctgtgggcagaacctcctgccacagcatcagagctgggtggagggaaccattttttctcaaagtggtactccggctctaagagtaagcagtggatggaagtggtgttattatttcctggtctttctggtttgttctttctatcaaggaactcctacattaccagggacctgggccacaggcaatcaaagtctcagatttctttgcttgctatccctgaggaggaacttcttctctaccagtgagggctatgtagatatcattagtttctatatattgtgaagtgatgtagcctttggagctctaattgaagatcaccatcatttctacagcattaaaacacatttccaatttgaatcagattaattgatttgtgattttatttaacatctcctttcttaccaatcactacagttgatactggaaatgccaagatgaataagacacacagaatgcaaagtatttataatccaatgtaacagatagatattaaaaagaaacacaaactatactatttatattgtcagttagcaggcataaatatgtacaaagtgtttgtataatatggagatgcctctgtgagatatgttgatgccaaagagaaacaatctcattaattgaatttccaggatttaaagatactacatagctagtgacgtttgatcttttaaaatttctgcaggaatttactaataaattgggagtagattgggtaaaaatgcctgcaagtaagaatatagaataaagtcacagaggaatttggagcatgatgtgttaaaataactaaaggagttcagtatggctaaagccatattaggggtgggtgaagaatattttaaggttcattaaagttttatctttgcagcattaaattgtcacagaaaccaagatgcattggctagcattgcaagaaaatattcagtatatgagcctaagctagatgttctgccttaaaatattggtggagaattttgtagttgtgctattacagaggatgtcaagatttcattcttcaacatggaaaatagtataactgatttactttgttcaagtttctcttaaatatgcagagaggttgtcatccttaatagtactgtgactgagccacatttaatctactggaagtaaattgaaataaatggaatatgtatgacactatgaagagttggatgtatacatgtgcaatgaaaatatgtggataaactgcataagacacaataaggaaaaaagctataacaaaagtagttggtatgaaggtttggcaatttttattctatagttatttcacatatcatatttctcctttatatagttcataatgccaagaggtacaagctgacagctacagtaggaaattgaagcatgaattaggtgatgtagattgtaattccagctctttatgacaatttttgccactctgaacaagtcgctaatcttcagagtttgagcttcaatattttaagatggcaaaattatgtgattctggtaatttacattctagattatttagcaaaattttccttgatttttgaattatgtgtgcacctcttaagtaacaaagcaaaatatatacattgtagtactttgtaataatcattattatgagtagcattaatttgttagtttggattatatcagcattgcttacatatgattaatgactctttaaagggaaaaaaaatcttgaggatcttaatattaccagaatttctattatgttacttaaaatgtacaaaaattttggcatatatttcttaggcttacatatgtgattctgctaatttacatgttagattatttaggaaaaatttccttgatttttgaattatgtgcacctcttatgtaataaagtaaaatatttatagtaatttgtaataaatattattagtagcattaatttgttagtttggattatatcagcatttcttacatatgattaattactctttaaagggaaaaatatcttgaggatcctaatattaccggaatttccattatgttacttaaaatgtacaaaacttcaggcattaggtcatattctaaggtactggaatacatttcttaggcttacatactcaattacaccataacctaaaattacaaagtaaatataaaacccgtaaaatgggtctggcacggtggctcatgcctgtaatcccagaacttctggaggccaaggcaggtggatcacgaggtcaggagttcaagactagcctgcccaatatggtgaaaccccgtctctagtgaaaatacaaaaaattagccgggcatggtggtgcacgcttgttttcctagccactagggaggccgaggcagaatctcctgaacctgggaggtggaggttgcagtgagccgagattgcaccactgtactccagcttgggcaacagagtgagactctgtctcaaataaaaaaaaaataaataacagtatcattttggcagatgatggtttgtggctaccaaatatatgcttataacacctttatggtactgacttcagtggtacagtttcttttacatttaataggtagaaactttcatgtactatgactataaagcaaagattttactgttttcctcaaagctaattactgtgaaactttcgtcacagcaacttaggaccacttttcatctttgcctgatgcaagctaagcatttgtagattaaatctctctttatcttttctttggccaatacaatgaatgtggtttctgcttatgtgagtgttcaaaaacataaattaaaatgaatatactgaaaatgattaagttgggtataaggtcgtagatgtgctgaagaccaattttgtttatgctctttttctttcacttgaatatattaacacgtttttacatttatattaaatacaaaatgaaaatctaaaatataagcacataatagagaactgggtaaacctgggtaatacatctacattttccaggagtaagcatatgcctttacgcgaataaacgaaagccaaataaatttgtataaaaattagctctgcactttgctcactataactgtttttgcatatacccagatactattcaaacatatacaagtcaggggcctcttataaagtctatcatcatgaacacttaggacactacttgaactacaaagtataaggaatgttttagaaatatcattacattttagaacattctctagagacttgaatagtataggtttgtatcattataactgaatgcagatttccagtagaccttccacactgatctcagatatctaaaaggagagggatttgtgccatttaggcaaaaggggattaaagaagtgacagtaggaaaaactgaaaataaagaaatactccagcctgggtgacagagtaagaccctgtctcaatcaatcaatcaatcaaggattgtggtagtgctataaaccacatttgtataattgcatgggcaaacagttatgcttttggtgtctgttcctcatttacgattctgataaataatggtatgtccatctaaggttattatgagatttaaatgagttcataagcaggatctgctgtttaggacccattgctaacattgaaatactgttatacaaattcttcattttttgaactagtaattatagatggaatgatgtatgggtatgcaagaaattgatatcatacagtgtatttggtaaaagaatgaacatttaactgattacagtgaatcatggcccattttggcaaaagaaaaatggtaaaaattaagacagtaaaaattactgatttgtgtttcaaatgatcacaaaatggtcatgtaaaaccataaagtacagttctctttcaattaccaagatttgttcatagtaatggctttaggtatatgtatatagatggaaacatttttcttttttaccaaagtttgatttcagaactttaaagtctaacaatgtgaatactatattatacaaaaagtagtttgctatacttttattcattttctattaattcctgttatattttttactctcaaatactattatgtaaagataattgccaaacaaggtatataatccttttaaaaatataatatatatataatatatgtaatattcaagataggcacaccaatacatgaatcaataatactagaatcactttttatccattttcaattaatatttcactgtcacttgtcagaagaaataatccaaagcatcatcatgattatattgaaaagttatctcattttgatctctgaagcgctgggtttgaatcctaggtttgatttttagtaattttgtgatcatacccaaattattagacctctttaatcatagtgttctatttctgaaatagaagttaatgccttttctattctttgtgtgtgagagagggagagacagaactaaaaataaagtgtacgaaagcacttttaaaaaataatgatccaccataatgttgttattgctattatgactaacatgataatcataatttatggttacattcttgaactcctctcaaaagaaaattaaaattcagagcaaaacctttccatatattgctggttttaaatcttattcaatggcaaaaggtaggaatagccaaatatttttatgtcctgttccacaaaatttcatttaaaagtattagaaataccaataaataaaacacccaaattttggtaacataactgaagatgaacaaatgctacaatgacaagtcagttacatgattaatataaaattacaatcatattaatatgcttaaaaaagttattggaagaatgataggatgacaaacagctgccatattcttctcattatagttcaaaaaataagagctgagaatatcataggcttactaaaattgagcttggctaaaatattttgtcaggtaatctccattttattgcccttaatctccattacatttctggtttaaaaaatgtgtaaaaattagtctgcagaatgaaaaactcatagacacaggccaaaacaagacatatcctgtcttcacagggtgatgctcattgtctcctaatcatttatttgaaatgagagcgtaaaaataacaattaccacaatttttaaattaataaagcatttctatatattattttgacataaatgaatcaataaattatagacaagaatcacccttcacatgtgaccaataaggtttacaaaaatatcttggtacaaattataatctggatatttttgttaactaaaggctagtttaatatataaaaattatctgaaagtataaactttgctaaatacataatgtaaattttcatatatttattctattcaattggctaatgcccactctaggattttaaaaattcttttaaaatttttgcctttaatatttttttcacctactattaagatgactccagataaacaagcagatataagcagaaatgtaacagaacctcattaaatgaacaaatttgaaaatcttcagaattttgtgggtttagaagctgggtgcaacaagagttgatattaaagaaaatggtttttgaaattaagatatacatatttatttgtgaaaggacaaataatattaaatgcatggctatgtttacctcagttgtataatacaaaatactaataccatacatgtaattctaatgggtaactttctaaacctcaaattactaccctgatgaatgttttactttgtactataagcagaaaaaaaatctgttaagaaactaacattaaacacctgtacagaaaacatatctgattttaaaaatccatgtatttgtagcatatatattttgattttttttttttttgagacagagtctcactctgttgcccaggctggagtacagtggtgccatctcagctcactgcaacctctgcctcctgggttcacaccattctcctgcctcagcctcccaagtagctgggactacaggcgcccaccaccacacccagctaattttttgtatttttagtagagacggggtttcaccatgttagtcaggatggtcttgatctcctgaccttgtgatccacccgtcttggcctcccaaagtgctgggattacagacatgagccaccatgcccggctgatttttttaaatttcaagttttattttaggttcagggggtacacttgcaggtttgttacatgggcatattgcttgatggtgacatttcaggtatgaatgatcctgtcacccaggtactgaacatcgtacctaatggtagttttttcagcacttgcccacctccttccctcccaaccctctctagtagctccctgtctctattgttcccatctttatgtccatgtgtactcaatgtttagcttccatgtataagtgagaacatgtggtatttgattttgtgttttgctgttaattaccttaagacagtggcctccagctacatccatgtcactgcaaaggatgtgattttgttcttttttatggctgcatagtattctgtggtatatatcaccacatttttttatccagtctaccattaatgggtatctaggttgattctatgtatttgttgttgtgaatagtgctgcaatgaacatacaattgcatgtgtctttttagtagaacaatttattttcctttggatatatatccagtaatgggtttggtggtttgaatggtatttctgttcgaagttctttgagaaatctctgaactgctttccatagtggctgaataaagttacattcccatcagcagtgtataagcattcccctttcttggcaacacaattttataacagatttttcctctgaaatatctacttgaaattcctgacagtgttttcctaaaacattttaacataaataaatgcataaatatttttctaattatttcattttaaatacaaatacttactaatttcactttacatggtagaaaatgactggttttgttaaatattttgaaattagacttacataaaaatggaagatcttatatatagttatttttcactgattcagtcttcttcctttcacattgttaaaataatatgttaaaagtaaaatcacgaaatagatatactcataaaacttacttgaatttaagtgaccattttatttatgaaagtcctctttgctagttttctcttttcttgtctgttacatataatgattgagttacagttacacgcatagcaacattttccattgtgcccctgtgttaagtataggcttttattctgtttctattctgcactaaagagtcagtagcaaacaagtttataaacatttcagagctggatgcataatcaaaactcataatccactccaacacccacttttttaaaatcaagacccacctaattttcttttccctctggtctaatttttacaaaaatttcattttgtaattatttataataatttatatctgcaatttctgctttgataaaactggtatgtcaggagcctccatccatgatatattgtatctttgcttatcagttaaaggagtccagaaaataactctccccttcctatgtaccatatttatggtttcacacttgatttttcctacaaagttggagggtatttcttaaagttctatatgtgattatctaaccttgcttggacagagaaagagtaaatcaggtgttagcttgtactttagggattgtcttaggcagaatattgactccttctgcttccctaacacttattaacgagtcaatttagctattcctaatgtgtgcatgcgtgtgtgtatttcagaacaatgtattatatatacaatttatatttgtcaattaaaaaatgagaatattaaaaatagtgaattagagaaaatattgtgcaaattccagcaaaattcctacagataagtttttaaatgaacatttaatttgattacctgtataatgactccattacactattaaaaaatagctttatgtgtaaaatttctatgtattttttaaacagctatattgagatataattcacgaactatacactttaccatttaaagtttgcaattcagtgattttagtatatttagaaatttgtgcaaccatcatcacaaatctaattttagaattttttttttaaccaggaaaagaatctattagcattcagttcccatctccccatctgctctaggtgatcaataatgtattttgtgtctatgcatttgccttttctgtatatttcttataaatggtaatgaccaatatgttgtctttgtgactgtcttgtttttagcataattttttaaggttagtccatttagtggcatgcgtcagtatgtcattcctttgtatcgccatctaatctttcattgtacagatgtaacatatttcatttatccattcctcagttgatagacatttggattatttccatttttaaatttttattaatgctactgtaacatttttggacaacttttctgtagatacatattttcaattttcttcagaacatggaagaattggaattgatgggtcatatgataaatttatatttaacattttgaggacttgccaaaatagtttccaaaattgctggatgattttacattttcactagcaacatattagggttcccatttctctacaacttaatggaaaattattgtctatatttttattatatttgatctagtggttgtaaagtggtagcgttttcaagtttagacttgtatttttttttaaatgactaatgatgtcaagtatatttttgtgtgcttacaggccactgctgtcttctttgaagaggtaactacttaaatgctttgctcatattttaatgtgtttatttctgtattgttattgaattgtaagtgttctttataaattctggctaaaagtaccttaccagatacatgattaacaagtgttttcttacattgtatataacaatatgatttgcaacaaaaaataaactgatttgcaacaaaaaataaacttaattttgtcaggcatattttgatgtgcattcatttattcattcacttgtttttttgtgtgtttatcatatcatttgtacttttgattttacaggtatacctcaaagatattgtgggttctatttcagatcatcacaataaaacaaatgtcacaataaagttagccattaagattttggttttctagtacatatacaagatatggctacactatactgtcaactatcacagcagcagagatcagagttactggtggcctgcccctctcagaatgaaactgtagtcctagaataggagttggggggtgaaggaacttctttgctttggagcttctgagcttttgtgacgctttgttgggtgggaatgagggaggaattaagggaacaatcaagactcaaataccacagactcttgtctctgattaccataaggttctaataggtgtttctcccttttttgtatgccatttaagacaatgtcaaagactttatttttttctttttttataaataactttcagcagttaaatttatgttcctctggtgagaggacatgctgagcaactcttaccaccattttggaaatcttttctagcccaatcaacatagcgagacccccatttctacagaaaaataagaaaaaaaatagccatgtgtggtggcacgggcctgtaatcctagctactctgtaggctgaggcaggagcatcacttgagtccaagagttcgaggctgctgtgagctatgattgtgccactgaactctagcctaggtgactaagaatctgtttcaaagtaatttgtttttaaagtttgtatttttttccattttgctagttgtattccaaataaaatagtttttgaaccaataaagataagttcactctttatcattgtcatagtcctcttctctccatcccttcatctgagctgggcctattgaacgctcactctgataaatggcaatggttagagttgaaatataagagggctgaggcctctccctaaggggcttggagattttccagttaggcttgtttttgtctttttaaggacacatgaacagattatacaactttttttgtgaatagtatttattagaagaggtcattggtacgatatttcttttagtcgtttcacgcaaattattttatcttattttccctaataaagtttaattgctgatacaatttgtccatgaagattggctaggggtaactaaaattcactttacctacaaattaaattagcacataagttattctttaaaacctactagaaatgtctccctaaataatgtatttgttcctattgttctcttattcaaaagaatcatgctgttctaaaataattatacttataccctaatttctaccttaattatccgaactatttatttatttatttatttattatttgagaccaagtctcgctctgtcgcccagactggagtgcagtggcgcgatctctgctgactgcaagctctgcctcccgggttcatgccattctcctgcctcagcctccggagtggctgggactacaggcgcccgccagccctcccgggtaattttttgtatttttttttttttttagtagagacggggtttcaccgtgttagctaggatggtctctatctcctgacctgctgatccgcccgcctcggccttccaaagtgctgggattacaggcttgagccaccgcgcctggcccgaacttatttctaccatggcatctatctttcaccaaagttatactgaaataccatccaaaaatgtgtttatttttatttctatatttatgatctttagacacactaatgtctaattcgaaagatttggcttattgtagttccactattttagcacaaagttaatttaaatatttgaaacaaataggacataaaatggtgaaaattgtactgctgctcacattattaaatgttttaactattagaatattcttttgctgtcattttgaacagtactagaattcaatacaagtttatcagatatttagaatcatcccagcatattacatatggtgttgctaaaatgtggacttaaacctattgcagcagctcagagcatgctcacaaaccaatatgtaaataaagaaaacgtaactagcaaatggaattctctgattctgttcagtttgagaaggaaatatgcaatgggagggatacatcaagtacactgattttctctacagattacctatttttccaaaaatgtaatcagtttttatttatctatgcttcaaaaaatagcactaagatggataattgcaatccaggattcaggcaaattaaaactgtatttcattcataattattaagttacatgtaagtcccatacatgtaattgtataacacaaagatcatacaatagctctgacttcaaaaaaaggctgccacctcagcttattattctcatatcaaggcctttatattgatgttctttctcagttcttgtgcgtttccctgaactaggttttcaggataacaaaatctgttgtttttcttctaaattacatttttactagtgttcagtttaatctaattgcaccttctccttaaaaaaagtaaaaaaaaaaattgaggtactagcaggatgtttagatatttatagcttgttttatttgaaaaatcttggataaacaacaacttttttgttgtttctggtgtttgttttgtgttatcatctcagtgacactgaggcctctttttctggccatggggggaagatctctcaaagagctaaataatatagaatctatttaacaatataatttagtttatttttaatttctgaaaaatctactttggggaatactgcccttgacataactggaacctgccccaccaaccttgttgtctttctattttccttatattcctattatttctccctagtacagtagacaggaagggcaatcaaatgcaaaatagcaatgtgaaagatacacaaaatgatttttctcattcaatcttattttggttgttcctaaatggtactatgtaatagcaataattatcacatggtgtgtttactatgtgtcagtgtgtgtactaagcactatgaatagattattgcactgattcctatactcaccttatgttgtaattactatcattctcagtttgcagttgatgaaactgacatacagagagtataggtgacttttctgcctatattgtgaatatgaaaatgtatagggacaagtacacatacatcaagaagactgaatgcaaataaaagtttgttgaataacacaaggaaaggctgttaatttgtaacattatttaattattcatgtcttatggtatgccagaggacaaaatcaaattaagagaactttatttgggtttagatttcaatttaattttctatccattattacaagtatatccacaaggattcaatgtgcctaacagaagcttggtggtcactgggaaaagagccccccatagtaatatttttttcctgtctttttcctgcctttaatatatcctcccatttgctcatattgccttttctaaatacatctgaaacacggtatgttttactgtagtcttctggtattcagattggaaatacacacacacatgtatgcgtgctcgctcgcactctctttcatacgttcttcaatcaaaaacttttaaaacaacaaagaatggctaagcagataatccatttgcaggccatctttaaaagctattatttcagttcttgctttttcattcactgtgtccttgtgacaaacatattttcaagtacattcctaaagtaacaaacataaggctaaatgaaaagcctagaataaactcagaaatgaagagaataaaaaagatctctatttctggtattgttctctcaatgccaggtctcatggaagaacaatataaggtgataaagtaaaaaataaacaaatagttcatagggtgattttatgttttaaaatatgtatttcaaagcagattcattattgttttaactaaggcctgagtaaactggagacaggggcaaatgaataagctgtatcggtccatgataatcatctttcttatcactctctcttgctcactcgggtccaaccatatagtccctttcaggttcatgaatacaacatatgctcacttgactcaaggattgtttatgtgtctttccttccagatatcaattttctcattatctcacttccttcagatcacttctcaatgtcaatttatttgagaagtttcctctgataactttctatcagataggacccattcctatacctaatcttttaccctgctgtattttctcagtaacatctttttattcctaatatataaatattcattgttttgcctactatttgttgctctagcagagtgaaaccctaacaggcattgttttatcttctgttacacctccaatacagagaacattgcctagtatatgacaagaactcataattatttgaagagagaataaagtaaataggggagaaaacatattctctttcaatgatctcactatgcattctaacctaattaccagacaccttggcaaatttgtaaaccacagaagaaaatagaaggattagaatgcattacatttctttatgtttcctgtctcactttggctagaatcactccaaattatttttgtccatagcctatacacaattatttctttaaaattgggtgttcagtcactaatattgttctatattggaaagaaaataattcaaaatagtatcagaataaaatttgaccaaggttatctttaggctttacaattaaatagtttgtgactctctttattttgcttattttggaaaaaaatgggcctttataaaacctgtataatacattaaagaccatacatttgtgattttagattgcttataatttcccctacaatttactctataaaaaagattatttaaaagaaagaaaagcaaaagatactcagattgttgttggttttttttcctcctcagctggttttggctgctcaattttaacactccccagagagctctcagacatttatgtgatttaatggcctactattattaagtcagaaatattttattttacattgagattgccataaccattgcattaacatttgagtaataggcaataacactgagaatgtatcaatgtatcatttagtgaattaatctgtattcccttcctaggacttgcttattgatgatgcaggataaatgtaatagtaacaataagtcatcaaacattctggcagacctgtcaggaagaggagatgggggtgcatggaagtgagcttgttgagagacagttcaatgcagaagaaatgacatatgtcatattttccccacagtgaaatgatagagtacatggggatagcttagtgatcagcaatgtgtgcaagttttgtttgcctagagcctgtggttgtgtttctggttaccctatgtagcaaaataataatgagttaattgaaatagcaatcaaattctgtaggaaataaatcatctagaataaaagaaaaaatgaaaaaattagaaatcacatttaactgtaaataatatctcctagctgtctatcagtccacaaattagggtgacgtatattcaaggcagaaaaaaaaatagatttgttgtgcatgtacaggaagaaaatattagaacttccatttatatgcatatttatctaaacataagaaaacatggactcattttcattaaagtgtgtaatattcagattgatatgtatgtgttcatggtatgctgtgtacaagttatcctgaagaagaataggaggtcctataataggcaagtttgccaatggctgccagactcctttgtggagctcagactgttaatttcagtatactgtgatgttgagcatatccaattaagttgatttaagaatattttctgggtttagtaaaatgtgtcctataaaactgacaagtgaaaaaaaaaaaacaaaactcaaaccaacatgaacaaactgtggaataaaatgagagtaataagaacaaagtataaaagaaaatagcatcactgatatttttcagagtataactatctaaaccatattatgaagaatagtagtctaatatgatgaacaccaacccccaaaagctcaaaatcacaacaatttaaaatattaatatttacctggtttcattaatgataaatcagaacttacacactgtgttttaagatgtgaatggctgtataaagccgtgaaaataaataagacattccaaaattaagcatcttgacaatgaagagaaccaaaatttttgagaaacatctcaggtcatgcaactcccagtccagtatttcatgcaaggtcaccaaacaaccctaaagagttagaattttattggaaaaattctcacttaaatagcaaaaggcctaaatccacaaacaattacataaatatccttttttttttttgctatggtaaaagtggtttaaacactatcaagaaaagaaaaacagaattagaagtctcttgtctgcgaacacaaaaataatgtataaaaattgttggaaatttacaaagcaagcattaaaacacatttattgtgtgaaacacttttttctttgaatttaaagtacatatgctgcttctgtcataatatagagaaaaccattgaatgaaagatgcagtggagaagataaattataaaagattgcccacaggagaaataatgtacaacttaaaagcacttacttcattaatgataagcaaggtaaacaaggtactgcagcaaaaaaggttaataactggaagcatcactggcaatacgtggtttcaatacttgtgttgttggtgaagagacccgctataccagaagattgtgcagaaatccgtgtaagagaggttcaagcattgggcccggatttaacaaacgtaatggaagaggtcaagtttcagagatattagagaagcaaggctcaaaaaatgtgctggcagatagtatgtggaatatgtggaaaatattgaaattgaagatgatacttagattaaaattttgtcaagtgcaactgaatggatgatgataccatagttgctttcggttaagagcatcaaatcaaacatactaaaactatgctctattatatgcatgatgaagtctggagagtgttctggaaaatccagcaaagtttaaataaatattctttcatagtctatacatttttctatttaagttcatttggctaaaaaaaaataagtctaggttatacctattaagtgtctacccttattagctgaggggaagagacactatcagttggtattctcctatatttatgaggcagctcctgtaaaacaaaccactgatcttttatggatcttcttggggttactagtgagcagagtagattttgttcaccaaaaattctcagaagaaatctaacagtaccttaataaagctgacttccaaggtcaccactaaattaaagctaaaaattaactctgttctatttttatcccaacttacttccaaccatattcagaacctggcctcaaaaaacattctcaaggagataaaatgacattataaaaatattctcataatgaaaaacttcaacaatacagatgaccaaatttgaatataaacccatgtatattatcaaaataagagatagatattttaagtccaagagatatatccttttgcaagttaaagaaccaaaacagtaacatccaaaaaaaaaattaatctaccgtaagttagaatttgcttctctgtggaaagacttaattctacaataatgctagtcctcataccttaatgtaaaatttagtgcaattcaaattataatcccaatgagtttattctttttaaaaggagattggctaatatgattttaagtgatatgaaaaaaatatccggaaaatagataagaaaaatataaataacaacagaaaaaaaaaaaaaaaacaggagagcactggccttaacacatatctaaacaagcaaaaatttgtatgaatagacaaatgtacacttttatagcattgagaatccagatataggtagtgtcaagtggaaataattaggaatatttaataaataaagacaaaatttatcttccaacaaaaaaattaaaaatgaatgcataaacaaatagcatcaattttataaaataaaattaattacaaaatttatgaaaagtaaactacactagaaaatactgatgtttgatcaacgtatgtaaaataaactataaaatagtggtatatttttgagcaatttattacaaactataaaaattttaattatagagaaaaaattattttcaatatttttgaagatgttataagttcctaggatttccaaacaaaaaaaaacaacaaaaatgaaatctatttatttgtgggaaatatataatcaagatagagacactgttgtcaagataacaatataccaactctgattccagggaagatggaataatgacattccactctactatttctcactgaatatagctatagaaagcctgcagctgctgtatgaggactgactcaagcaaacagtagcaggtaaaatgggtagaagacccaaatgccagtgaatttaccattttttcccctcaaatatccatagtctgaacgcaacgcttcagaactggccacagatggagttagagagtgatgggagaactctggttctgactcaaagagtgggaaaggagactcccaatgcctaaagagaataccagattccttccccatcccagcctccctgtgccacatccctttttttgttgtttttgtttttctctctttttctttgtaccagccttaagcaattccgtcatgctggtggtgatagccgatggtgacaaaagcttatagtagtcaaaattatgagggaggggaactttcctttctgtttgctacagtcatttttccagggggtaggggcgactcctattgtttttgttttatattgccttttcttttgcttcttgcatcagatggggatgcagtcatggaagtgaagagcagagtattaaaccccaacttcctggcaagaggtctaagtggaaagggaactggagtgcacaggggagatggcagagggaggagctaagcaaagtgaccccatcacatttttaataaactcctaaatcacccctgtgttgcacagatgtggatctgattttattcagcataccaaagacaaagaaaatatagtaatagaccaccaaccacatcacagattgaccattgatggcaaacacttaggataaatacaaatacaaacagaacaaaggtttgaaaacagaatggacattggagacaaggctcagggaagacattggaatttgtgacctgaaactaaacaaatcaactgcttgctaaaataaaatgcatatatcctcaataggatttaaataagatccagcgtctcatatttattatttaaaatgcctagggtataatctaaaattattcaacatatgaagaaccagaaaaatatcaactgatatgggaaaagccaatcaatagatgcccatgtttaaatgtcgaatttatctgacaaacactttaaagtagctatttttaaatgcccttgtaaataattgagaacactactgaagtcaatggaaaaatacaaagtctcagcaaatagataaaatatataaagaagaattgaatgaaaattttacaattgaaaattgaaataactgaagtgaaagttttcattgggtgggttcaattcagaatgaagatgacagaaaagaaaagtcagtgaacttgacagcagatcaatgaagattatccatctaaatagagaattggtgaaaaaagtgaagagagcctcagacctgttagacaataaaatttctagcatttgagacatccctgtaccaagaaaagagatgaaagaatgcagtactgaaacaaacaaaacaaaaaccttgaagaaattgtggctgaatatgaccccactgtgctaaaacacataaatccatagattcaataaatacagtgaaatctatacattcaaaacaaaacccttcagacacatcagaaggaagctgctgaaagctaaagacaaaaaggataatatagcttgagacatttatactgtagctcttgctgttggactcccacataatatatctaggctctaatctattccaatctgccagaaaggctttgaaataattttcttattcttcttcattaattccagatgaattatcctggtgtttgttttaaaagaatgttgtgttgtagcttctgcctttttgttaaattgaaatatgtgaaaataaaattaaacgcccactgaggtcatcatactctacttatccaaggtgattttcctttaactgttttatgacctagcagaaaaatattaacatactgtaatttttatatatttgaattatttgtaaatgcagtgttctgatgtaatgcataagactgagatattttataagtcatatacatattattgtgaatgacatccatcattgaaattattctaaaaacaatattttaatgaaattactctaaaagcaatttgcattgattcagaaaggtcttcaaaatagaagtcactgtagaccatagctatatttgagctagattcataaaaatacaagcaatagaaagttaaagttaatagagtgctacttcaaaacagtatacatggatataagagtacacattgtaaatggaaacttttttctttttattacgtagtgacttagtcaaactctaatatcctatctttttctgatttttcaggcatttcccccaatacaatataaattctactgtatcagactcaattcttagtaaagcttaatctcattgaaaatattaagaggatttaaaataaatcttaaggtaggaagcttaaaagtgctttatatctataaagtcatatctataaagtcacctaagaacttcaaagtttctaagaaggcttgctaaaagaagtctttaaaacatatgccgagataacatagcatttattttgatacacagatttacttttatctcttagaactttttcaaatcacctgagcagttgagtattgctcttttataactaatcccttcccgcacccacacaccctgatgtatatacagaccagtgcacacatagaaaacaactggcttgtgtattgatttaatgatgagatattttgggggataaaacaggtatggttaaacacatctactaagaccactaatattccgactctatttcattttgaataaagtgaagaagatcctagttaaagtgtaagaacaagtaggaaattcaatttacacaggatggagtggaagaggtaattgtacttgaatggaatagaatgttaattatgaaaagaaaaattactgcattttgaatgataaataactttctaaatttcagtacaataaaaaattgatagacacagaactgcaaatgttagattccaaagttattgtggaaagattaatttggttacacatcttttaaaacaagaccatagtaaaatgtggaattcagtatagattttcatattctaaggagcttcccaatttattactgttcaaaatagtggaaagttatgtagggctgttaataagtggatgtttggtgccttgcggaataatgtttcttctaatatttattttcatatgaaatcaaagacactggtaatttaaaatgatacacaaaaggaaacagcacatttttacagcataaagtaacattttgataaaagtattaatatggctccattttcacttttgaaaaataaacatgaatttacacatttttaaataaaccatgctcataatgttcaaacatatcacttgaattagttcaagcaaaataactgccattgaaatccttatacaaataccagtgatatttttcacagaaagagaaaaaataatcctaaaattttatggaagcacaaaagacccagaatagccaaagccatcctgagcaaaaagaacaaaactggagatatctcattacctgacttcaaattatgctatagagctattgtaaccaaaatagcatggtaccggcataaaaacaaacatagaccaatggaatagaatagagaacacagaattaaatccatacatctataataaactcattttcaacaaagatgccaaaaatatacactggggaaagaacagtatcttcaataagtggtgctaggaaaattggacatccattttcagaagaatgaaactagatccccatctctcaccataatcaaaaagtaaataaaaataaattaataacttaagtcataaagctactaaaataaaacattggggaaacactccaggacattgtctgggcaaagatttattgagtattatcccataagcccaggcaaccaaagcaaaatgtaaaagtgggataatatcaagctaaaagcttctgtacagcaaaggaaacaatcaactaagtgaagaaacaatacacagaatggaaaaaagtatttgcaaactacccatctgacaaggaattaatatccagaatatataaggagctcaaataacaggaaaaaatcaaataatcaaattaaaaattaggcagatgatctgaacagacatttctaaaaacaagacatataaatggccaacaggtgtataaaaaatgttcaacatcatcagagaaatgtaaatcaaaaccacaatgagatattatctcacctcagttaaaattgcttttatccaaaagacaggcaataacaaatgctgatgaggatgtgaggaaagggtaacccacaagcactctcaggaggaatatgaattagtacagccactgtggataacaatctgcaagttcctcaagaaagtaaaaataaatctaccatatgatccagcaatcctgtgctggataaatattaaaaggaaaaaaatcaatatatcagagtgatatctgcattcccgtgctgcttgcagcactaatgacaataaccaagatttggaagcaacctgcatgtccatcaacagatgagtggatagagaaaaggtggcacatatacacactgaagtactattcagtcataaaaaagaatgcggtcctatcattggcaacaacatgaatgaaactagaggtcataatgttaaatgaaataagccaggaacagaaagacaaacttctttttttttttcttttttttttttaattaaagttttagggtacatgtgcacattgtgcaggttagttacatatgtatacatgtgccatgctggtgtgctgcacccactaactcgtcatctagcattaggtatatctcccaatgctatccctcccgcctcccccctccccaccacagtccccagagtgtgatattccccttcctgtgtccatgcgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggccgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctctaatccatcttgaattgatttttgtataaggtgtaaggaagggatccagtttcagctttctacatatggctagccagttttcccagcaccatttattaaatagggaatcctttccccattgcttgtttttctcaagtttgtcaaagatcagatagttgtaggtaagcggcgttatttctgagggctctgttctgttccattgatctatatctctgttttggtaccagtaccatgctgttttggttactgtagccttgtagtatagtttgaagtcaggtagtgtgatacctccagctttgttcttttggcttaggactgacttggcgaagacaaacttcacatgttctcacttactgtatgaggtaaaaatgaaaacaattgaattcatggagatagtgagtagaatgatggttactagaggctggaaagggttgcagggaaggagaaaagtaaagatggttaatgagttcaaaaatatagttaaaatgaaaaagatctagtattgatagcatgatcaggtgactgtagtcaacaagaaattattgtacattttataaaaactaaaaaagtggaattggaatgtacctaacacaaagaaatgataaatgttttagacaacagatactccctttactctgttgtgactattgcaaattgtatacctatgtcaaaacattacgtgtaccctgtaaatatatacatctaatatatacccataaaaatttaaataaagttttaaataacttttaggttaaaaatgcgaagatattaacatggatatcattttccagttagtgacagaaaaaaaattgttggaatttaaaagtggggggaaaaatccactgacaatagacaaagcaagggaagaagagttgaattagaggagaaagcagcactttccattcaaagtaatttgatccaaaatttccacaatttccctgtgatataggtaatcttctgagaaaatctgcattgtatattgtgggatacaggattcctgtgaagttttgattattgacgtatttaacatttgtatattctatcgtgcatggtagtttaatctcaaaagagaaaaactgtttccctttaaaagttgatgtagtatatgtcacaagctgtggggaagggggagagctatgtaatccaaccaacaaataatttcaaaggttaggaaaatgtctttcttgcattggttaaaaactaataaaactcctatcagacattatgagagcaagattgtctggttctagtacctacagagaaattttgcggtggaatataaatgaatccaaacaggtatgccactgcaggagatacaatggaatgtatactcagagtttctcaaaacacaaatctaccatatgtttaaggctgaaagttaaagtaaaattttctggtttttgaccatttgaaattaactaaaattggtaaagcatttgtgaaatgacataattgtgaaatctcccataaaagtattttttaaattttggggaaaaagaaaaattgatacaagtaggaaaaccctgcatgtggaaatgcaagctggaggggagtacagaagaaaaaataaataaacttttgttacttctgaatatctgataatttccagatctacgcaagatgattaagaatgattacagaaatttaaatattttcataaagatttaaaatgacaaatcctagatggtagacattactgaggtcttgtgtctcttcctttatacatatacctattgaagtaagttgagactttggtcaatgaaaagtgaaaggaactggtgttggtcatttcaggatagaagcattaaagagtcattgctccacccatgtcctcttcttccctcctggtggtaacaaatgaagttgcaataaactgaaacagctggaaatacagagtgagtcattaggtagggaaaaaaactgcttcagagattcctgcagttttgcagcaaattttctgtaacccagaaccaaatgtcttcggtgttaatcttctaagattttgtctttgtgcaccacagtataacatatcctatcctgagagagacattgaataaatttaaaaaaaatggttgatgtgtttttatacttgaatgcaaatttagatagtaaaattgccacttaagaattacaacattaaatagatgaaatgttgtatttcagatgaaaaatttatctgtttagaaaattatacacaaagccaagattattggtttgttttgtttgtttgtttttcaaaatcttctttggctccataggactgatcagtaaaaatgataaatcttcacatggaatttaagacctaactcgacatatctttcaatttctatctgatactagtgggaatgtactcctaattttcatgtgcttgaaaattcaaccaaaagtacagaataatgaaaaatgactaagacccaggatacatagtgacactccagttctgcctggagtagaaactgtctttggacagctcatgcaatctctctcaatttctcatctgtaaagtgaagtggttggagagtagaatctctttaatttacgcaatatattagtccattttcatactgctataaagaacggcctgagaccgggtaatttgtaaagtaaagaggtttaattgactcacagttcagcatggctgaggaggcctcaggaaacttaaaatcttggtggaaggcgaaggggaagcaagcaagcttcttctcaaggcagccaaaaggagacgtgcctagtgaagggggaagagccccttataaaaccatcacatctcgtgagaactcactcactatcagaacagcatgggggaaactgtctttatgatgcaattacctccacctggtctctcccttgacatgtgggaattataagaattataattcaagatgagatttgtgtggggagacaaagcttaaccatatcactcaatttcaaagacctgcctgcagatgcctgctctactttaccacacaaaggcttttatttctgttgtttcatttctctgacctatctttttcttattattatttcctagaaacatcttattgtttctatggtttatcaatgtttcaagtacccaccacaatgccactttttccataaagcttttcttctctcattaaaattgtctttgtttgaattatattacattatcactgcctcttgtagtgtttattttttaatccatcaattattttcatattttgcctattcaatatattataaatttataaactgtgaaatacacgtttaagattgaaatacacatttaagattacttatatgtcacacaatatccaatatggcccttttatgttgtatgtgctctaaatacacttttaagaacaatgggtaaaaaagcacaaaaaaacacgaggacaaaaataataaaagagaaaactgaaacatggcttgtagagaattattttcctataagaacttattagaaagagatcactacctttattctatcaagatgaattatttgttctttgactctattaatccattttccaaatattacacttctatttactattttcttgtctaaaacctaaaagcttttacttaatctaggtctcagagttactaagtactatcatcattgtttggagcgactttacttgggggaactttgcacttcactgatctttaaagagtggagaataagaacatttcagaatgcattacgaacattttaagagcagagaatgttatctatgtcactcaggttctgttggattatctcacacaatactgattgtcacagtgtggaatcaagaaaaaagtttaatcaatggttattttttaaactgcattttgaaaggacatatataatatgtatatttatacatatatatttacattcacatgaatatatatatacacacacaaacatatatatgtctgatataatttttacatctcatccaaatatatacaaagtgagcagaaaataaggaaaaatccatatctgtctggtgtgcatgtgtttaccactcctctgttgttaagcagcaaatatcaagaaaactcttaagttgcttgtgtttaataaaagactgacatgttccaagcaatagtaaactcaattatggtttgcataatgattaacaaagtgttattctcacacactgatttatttggtattcacttaataatataaaacagataaagcaactatgtatagataaaaaataagaagattgtcatttgtctatgatcaaattgttaaaaattttaaggtcatggcttgagcctaagttttcttattctaaatctatactgctttgtttcttcaatcataagtggtatgtcaaaatttttccacttggaaaattttaactgtattttttctttaatcctttcaatagttaactttatttgctcattaaatagagttgttttaccagcatacaaaaatgtttactgttttctgtctatgaaacagtctatagctgttctgaaagcaccacgatattatttgaagaatttgcttttccaattgaacaaggtctactaacattatatttatggacacgttcctcttaggccagtggatcaaactattcaatcaaatcttccctccttagaatataattcttatcagagatcaaaagagaaaagtacactgatcatgttgagatttatcctgtatcccatccctaaatctctgcacctgatttagttctaaatagctcccaggtgctttttcctagctagccttctgttaattctgagaactcattatatctttccagtaacatacctttgattcaattagccagtgatatttgtgttacttcttactaaagaatcttggtactattggtcataatcaatttaatcataaatatttttctcaatacattacatgtcatacaggactaagcacatacttaatcaaatgtgatgattggaagacaaaagacttaatgtataattgaataagaaatgtattactcaatataatgaatcgtctactgagaataacattcagtgacctgcccagcccagaaacacgttaactcattcacttagaaaatgacattttgttactcgagagctagaatgcatgagatgtaattatcactgggtaactacaagagtgatttttgcattcccataagtctcagggttaaatttctgtacttcatcatatatatgatggaagatataatttctttaatgatataatatgatatgaaatgatatatattatgatatgatacaataagaacaacaataacacatttatgtattagtttttcaaccatgggcaaaacaccagacacccaatttatttaaagtacacattgtgtgtttgagatgcactagttaggttcatttaaagctcatgtaggtatctctatatttaaagaatacctttaaaagattttaaggggacacccatattaagaggataattggtggactctattcagtaactgtccatcatatagatcatcttgcttataatcataaagccattggatccgtcattgatattatatttttccaagtccattgtataactcgggtctgttatgaagtagaaatggttattaatgtaaacaatcaaaacatataaaaaggagataacttagttttggatgacagcgaattgtaaacaatgcaagaagcaggttacagtgacaaacgcctataatcccagccctttgggaggctgaggtaggtgaatcacatgaacccaggagttccagaccagcctgaggaacatggcaaaaccccacctctataaaaaacacaaaaattagctggtcatggtggggtgcacttgtagtcccagctactcagaaggctgaagtgggatgatcacctgagcccaggaggttgaggctgcagtgagctatgatcgtgccaatgtactccagccggggtgacagagcgagaccctttctcaaaaataaacagacaatgtaagaaatcagaagttaaatatggagagtgttgatcatataagtgtaaaatacctgaaatcctcaccaaaattcagtaaagtaatatgataaagtgttattaccctttacataaagaaatagctcttccaaaattccagaaaattaataaaaactaaaaattaaaagtcagttttaaaacaggctgatgaatttgtattataattaatgtttgaggaatcaaaagtaatttattattttcatgaatattggaacaataaaaatatgttttctataagggtagcaagtagctgatttacaaataaggcatagaacttcaacctaaaaagcaaaaacaaggcaaagctgtgtgtgtgtgtgtgtgtgtgtgtgtgtgtgtgtgtaatttaaaattaaataaaaaacaattgtggtagcttgcgcttgtcagttacttgataggcagaggcaggacggtcacttgagcccaggagttcaaaactttaaggtgctataattgcacctggaaatagtcactgaactccagcgtgggcaacacagtaagaccctgtctctcaataaaaaacaaggaagtagaaaaaaacacagaaaagaagtcaagagaataggaaaaaagccagtcatgatggttaatagtggaggaagacagtactgagaaaaaagtagaggagttaggcaaattagacatttaaattttctttctttcttttgaaataatatctctgcagtaaattatttggaatgttctatttaaaaaaattaatcaacctgcatttctggtaaccaatgatatgtctttccagttgttatacctagcaaggcactttttgaaccaatttaaagttatttaccagcgaacaaaggaaagtgttaccaaaaattctaacattcaaatatttatttctcctttgtaggaaaagtgtactaataagtgctaattaacatttcttctgttaaatacccaagttattctttgttttcaaaattgtaactacatttcattgcaaattgttttcattacttttaaacatgcagagaatgagactggatttttaaaaatagccagaattttgatgcacgtaagacattcacttaaaacaccaaaagtttagaaaataagtacacctcagaatagaagtacttctttgtctctccttaaataatcaaaattgtattgcaaatttgggtactttcggccattttattttgagaagactgtttagttgttgttagtgaaatcaaaagaaaaatagaaaataaataaaagtgatttaataaaaaggtatgctttgctggtttcctttaggttactggttgtttatttttctcttgtctcacatataatgaatctctttcactgtttaaaggtatcatattgataacaatgaaagactatttactgaacttattgatgtaattttgctcataattactaaatataaaaaaattaaaatattctcacaacattctaaagtaaaaatatttggaatgatttttacttacattatcatagatatatctgtgtagatatatcttattctatttattttatctaaaataatttattttgatattatttataaacaatattctattgcattagtatacaatgcaatacagattgcattgatttttaccctctagaaaagttcagaaagattttaaaacataagtagcctactccatataaaatttaagtacacatgggcaacaacagaaattggagactattagttgcagggcagagggagagaggcaagggttgaaaaactaattattgggtgctaagcttaatacctgggtaatgagatcttttgtacccaaacttcagtatcatgccctataccctaggtaacaaacctacacacgtaccctcaggatccaaaataaaagttggaaaaagaaatctctaaagaaagtaatttgtttttcctttgttatcgcatagaaccttatctgtagttcttttaccttatttggtcttgaattattatttgtatttatggattgtgtcactattaggggataaggtatttaaagcagggactatggtttgctattctgtgacttttctacaactctgaacgtgattcctaagagaagtgagtagatgtttgctgactggacctggaacatgtgaatatgtctattattatattttcttaatatggtatgcttaatgtagtgagctaaacaaaataacaatgtgtatagagtattgtttaaaataccccacttccaattgtttaaagtgcaaaagaaattatatgtttgaaagttaggtggaataaatgaagattaaatgatatagaactactcagaaaacaggatgactttgtggggaagtgaattttgaccctgcttttgaagaatatatcaaatgtaacttacagagtaaggatatgtgggaagaacataggctgtggatttcagaaaatgctcttattttttagctatgcaaacttaagccatttaacctaggattctattttctaatctgtaaaatgaaggtaacagcactcaccttaacttactgggtgttttgaggtttaaatgaaatacagaatttgataatattttgtagtttctaattttgagtacacatctaaaattttttcatctatttctttaggccatcagagaataaaaaaattaacatttaagaaaaaaatatgtttgccttgtaagtaagaaatacagtattatccttccatatctcattcttgattttactatatccaagttgataatatagagagaatttttatattttattttgcagtgtaccagataatccttcagataattggtataactgttcaatcaacttaagattatgatattctttactattcattctagttattgcaacacctgtagaacctatatttactttcctgtcagtcagctaggggaccatacagactttaaggactggttagagaatgataatattgatagaatagaaattgattctgaaacagtgaaagaggtttgactcttacatataagactataaatctatgaaggcggaactccatatacttttttcaccattattttctttcactttgatgcatggcacctaaaagctactttacaaagatttgttgcatgcatgcatgaatgaatgaatgaatgaatggatgaatgaatgaaatttaaaaataaaattttaaatccacaaaaatgctttatgtaaattgatcgtggtgcataagccttttgatgtgctgcaggattcggtttgccagtattttattgaggatttttgcatcaatgttcatcagggatattggcctgaaattttatttttttgttgtatctctgccaggttttttacaatactgtgttaaaatattaaaaactagttcattagtatcatgagctcaaagcaagaaagaacatataaaaaattttcagtgttaatttctacttaagctactctacaatatctgtttaataaaaaaaactgaaaattttaaattaacatttatagttgttataaatacacatcttaatgtgtgtgcatatatatatatatatatatacatcttgagacatatatatacacaaacattgatatatatatatatatgcacacacacacataccttgacatatatatatatagagagagagagagagagagatcacacatgtaaaaaatttgaattaagccctatttttggttcacaagtcttgcttcttccagaatttttctgtacatgtctctcaagcagacaagtacctcggcttttcagaagcatgtgtgatcctgaagagatttgaaaatacggactcctggtgctttatgcaaggctataaaaaagctccaattttcaattatgattgggtaaaatatttctcagttatataatatttttcttgatattaattctgcaattttcttttcagattttctagactgtaataacgttccactgatatataataattctatagttgggaaaatgactaatcgcatgaaaaagaaagggtactgtgagaccatcacttgacaaaaaaatcgatcatagtctgcctcaacttgagaggcacagtctttataagatatttaattcgtcatagtacattgcctgcaggagtgttacacagaagtccaaccagtgttttccatggggtttcaccctagatctgatgaatcataatttatcggatgaagcacaataacatatgtttatatgttctttttaatacctctcttatattttacttatgtatgtatttttctgtccttaggtttaggggatacgtgtacagatgttaccctcagcagtgtataagcgagaacacaggttcgtaacaattccgattggtaactatcatgcaaccagctaaattccaggtaaacatatgagaatcaaaataccaaaactttaaaattcaaacaaacaaacaaacaaacaagcaaatggaaatctgtttcctgcaaagtatgaaatattttaaatttttctatccaatttcttcaaaaaaccaagatggatctcttcttaaacctatacctcttcaaaaattggccatattgaaattaaccttagaaaatgtgtgtctcactatctctcccctctaaacacacacacacccacacacacacacacaaaagcatataaagaaaacatacttgtgtcttattatgcacaggataattgctaatgtaataggcaattatattcagaaatgatttgcatattcacaatgtaaaaatgctgttatgctgtggatatgcaatgaataattaatcagttacacttgaaacaatacctatgaaacacacactggtgtttagcaataatcatgaaagaatcattgcaaatatgtatgtgaaatagattacaaatctatcattaaaattgattcagcaatttaagatatttgatttccacctaccaaattattaaagagataaactttactaggtaacccatggttttggttgtagatcatatgataaaaaggataaattatagatttgaaaagatcatgaatattatgtatttcaatatcatacttagttttataagtaatataagtaaacaatagttatgatgtttagatataatttacatcctccctttttccctactccataaaatatatttgagaaaacatacaatcaaacattaatgcaaataaagtcattgataaaaatagagatcacaagagcaattccctgaagatagggagaataatagaaatggttatgaaagcattgcaaccaagttagaacagttactgagcttggaaagaaacatttaactttgaactttttagcaactatatcgaaattggaaatgtaagggattgtatcattctcattctctagaaagaagaacatcatcgttttatctggaaagaaaaactgctagaactaaacgcaagaggaattgttttttgtaacataacgtggtatttcaacataagtttttttttaaaaaaaagatgctaagatctcttgatataattttattttacatttctaatatcctactaatggttagctttaatgattgtaaaactttcaaaaatgcagtcaaatcagtaaattttattataattttcttttcaaaatttataattgataccttaatttctcatattacaaatatttaaagaataaaaaaatgaaggcaaatattatctccaatctaagcctaataatagtcattattcagccttgtcatcaccctgatcattttttcttgactctaggctctgtttgtcagtatcagctcttaaaatgacaaccaaatcctgctcaataattcaaatatagtttctagtcaatctttgtccttcatgtctttgaacatattccctatatttcataatcacccacattgtgtgtcccacttcccaaagcataagttcaaacaaacaaagaaacaaacaagcatgtctagattatcttggagtttaggtatatgtgtgtgactcagattctagatatcacagtgagagaactggatttaaaagggagcaacctgtggaggcaattgtataagggggatgtcatctccagacaagtgtcatgtgtaggtatttcctgaaacaagcagtaaagaacttgtgacatccagccctgagtcttataagacttggtagttctgagtttctgctacagcagctgctgtgatatgtgggttagatgtgattcctatctgtaaagctacagaatctgagttatggcactcatggagactgtcttaattcagcctgctataacaaagtaccatatactaggtggcctatacacaacagaaattatttctcacagttctagacactggaaaattgagatgagggtgccaggatggtggggatctggtgagggtcctcttcctcttccaagtttcagactgctcacttctcgtgcatcttcacatggcagaccgagggcaagctagtctctgacctcttcttacaagtacaatgctaatcatgagggtggagtcttcatgacctaattacctcccagagaccctacctccaaatatccttacattgtgggttagagggaaagaaatattcaattcataactttctattcttccccccaaattcatgtcattctcacatgcaaaatatattcaacttaacagccccaaaagttaacttacactagcatcacctctaaagtttaaaatgcaaagtcttacctaaatatcatctaaattagatataggtgcaacttgaaagccaattcatcctgaggcaaaattcctctccagctgtgaatttttgaaaccaaacaaattgtgtgcatccaagctacaatagtaggacaggcataagataaacattctcattccaaaagggagaaataggaaagaaggaaggggtgatgggtctcaagcaagttcaaaacctagcaaggaaactccaggtgatcttaaggctcaaggataattctctttggctagatgctcttccttctgattccactggggtaggtgtcctgccttccagaattattggatcaggagttacatctttattgctttgggtggccctaccctcacagtttggggcagcccctctgctcatggttttgagtgaaggccatttgtactgttgaaagcaacgtgaagtccccaacaccaacacaaaatacatcctaactgttctcgcttaacacactttctcattttttttgtgatatggataggctgagaattttctcaatatttaatttctagttctttttttcttaataatttggtcttcaagtcatttatctcatcacacattttactatgaaaagtcagaaagaagcaagcacttcttcaacattttgctgagaagtttcttcaattaaatattaattttattgattgcaacccctaccttccacaaaacaactagaacataaataaaattcagcaaagttctttgctagtttataacacagatcacttctgctccattgtccaataacatgtttctcgttttcacctgagaccataatggcagccataatgcagtgttctatatatgatttatgtattatttaagaaaacagaaactttctctacctctcttctctttctgagccctcaccagaattgtctttaaaagtctcttcacaagagtcttagcttcttctagcatatacttctttcagcttctatccattatccagttctaaaattgctttcacatttttaggtacttatcataacaacatcccaccgtctcgataccaaaatctgttttaggattctccagagaaacagaatcaatagattatatatatatatatatatatatatgaagatttattataagaaattggctcacaggaagctggaagttgagaaattccacaatctgctgtctgccaattggagacccagaaaagttggtggcataatttgaagttctgagacccagagagtcaatgatggttccagtctgggtatgaaggcatgagaaccagaagcactcatggcaaaagatcgatgtctcagctcacacagtagggaagagggcaaattcaactttcctccaactttttattctattcaagctctcaacaaattggatggtgcccaaccacactggggagggccacatgctttactcagcccaccaattcaaatgctaatctcttccagaaacatccttaaagacatacccagaaataatgtttaaccagctatctgggaatccagtggcccagtcaagtttttaattttttttattattttttatttttttagttggagtcttgctctgtcactcaggctgtagtacagtggtatgatctcggctcactacatcctatgccccctgggttcaagaaattctcctgcctcaatctccctcatagctgggattacaggagtgcactaccacatccagctaattttttgtatttttagtagagactgcatttcaccacgttggccaggctagtcttgaactcctgacgtcaagcgatccacctgcctcagcctcccaaagtgctggaattgcaggcgtgagccactgcacccagcaccagtcaaaacataaaattcaccatcacagagaccatgagctctaccttcagccagttgaaggagaaaatcctgaatttgattttcagcattcttagtcctatgtctacaggaggtaaagttctcagcatacatacagctttcagattgtgtacatgcgcttaaactggtaattcaaattcctgagctcatccttttcttttcccagtctgtctagcaacattaggaaaaatcagccaattactttatatttctaaatttgagacaaatattcaaaagtatcatatactcagtcactgagatctttgcttcttataagtggttggttaggagtacccaatggtgactatttatttatctctattgccagatcattccatgggcaatcagtgctctttgaactgctgaaaatagtgtcattatgagaggagagtgttcccttgactttgacccccttgaccttgaccttgtcccttcatgagcaggaaccgaaggggctcatttcattcagcctgcagtccatggatggctaagagttaacagctcactaaagagtgacttagggccaagattccaggtttgagggtagagtttagccaggagcccagccattctgcatcaatcagaatctaaatctaatcatgttccagagtcaattccaaaaaccccagaaccatttctgaacaaactcatctttaaaaatctcttccttttgaaccattctcagtatcaaaatctgtattagttatggaaacagaactattaggatatacattaatccattcatgtattataattattacatatatataaatgtcattcttaacacagtaatgaatacattaatgttatattgaacaaatttaaaactcattctcacggataagtagaatcagcattcaaaatatcttgacattaaaaagtataacatatctaaaaataactttatgcataaatatattggcatgagcggccttaatctcccacagatgaataagattaagattaggatgatagggcctaccataagcatgtgtgcgatcaagtttaatttataaattagtcacagtgctcttgcattttggggcctttattaagtaatgtaaacgttacttgaacataaacactgcaataaccgtaacagtcaatttaataatcaggatggctaattgaataatatgtgatacactggataaaaaaagattcatgtcataagagggagggagaaagatgatgtgagatttcatcatgctactcctaatggcacataatttaaaatatctgaatggtttatttctggaattttccatttaatattttggacagtagtcaactactttgactatacagttaccacaggtaactgaaaccatggaaagtgaaactacagataagtggggactactggactgttagtctttccaccagcattccacaagtgactccacagccttttaccagtgtaactctgcattaagggaagggaaacaatcatgagatagaaacttaaaaataaatatgcattcattcactctaaggaaagtaacaggcaaggcaagggttacaaagaaaagaacaaactttactctacctagcaagctcacttcaaggacaattataaggtaacactctccggaaaggcaaggccaaagaaatgggctccagacacccccaatccagagcaagtttgaaggggaaaaaaagagaaagacaaattatttccctggtttcttaagcatgattatgttttacaaatgtctgtatttagccagttcttgttttccttgcaatgcagctacaaggtcaccagctatgcaaggccacaagttatgttatgctatacgttacgtgacatatcaccgtatgattaactgcttttgttttgcttctgtaggtctgcttataaaaaccccactctgtctttgttcaaggttcagctttttgtatgcgaatccactgagccagtgcgtacctaaaataaacaatcctcctgttctccatattggtctctcctgtcctcagtttcccgcaacaatcagaccttttaaggactactggacactgtccctgaacccatactaacttcaggagacataaaacatcactggtgtctaccagttagaactggggcttatggaggtcaggtgagcagtggagtttttacacaggttcaaatcacaaggggcccagtgagtccccagacacaccctgtggttacttccccagttctggaatgcacaataggaatatacatactcagcagctgacttgtggagtgaagattgttatggtagaacaggacaagtggaagccactagaactatctctaaccaggaaaactgtaaaccaaaagcaatatagtatttataaaaagattgcagaggttagttctatcatgaagaattgaaaaatgcaggggtggtgatttccatcttatctcaattcaactcctctatttgatctgtgcagaagacagatggatcttggagaatgacagtggattatcaaaatcttaaccaggtggtaatcccaattgcagctgctgtacaagatgtagctttattgcttgagcaaattagcacatctccttgtccctagtatacagctattgatctagcaaactgttttcttcattcttattcataaggaccaccagaagtagtttgttttcagctggcactaccagaagtatactttttctgttttacctcagggttataaaaattcttcaggccattgtcataatttggttcacagggatctttattacctttactttctataagatatcatgctggttcattacactgataacattatgttaattagaccaagtgagcaagaagtagcaactactctggaccaattggtaagacatttacatatcagagggtataaatccaacagaaaatcaggggacttctaactcagtaacatttctaggggtccataggtcctgtcaagatatcatttctgagttgaaggataagttgctgcatctggttcctcctacagccaaaaaaaaaggagagagagagagagagagagagagacaatacctagtggcctctttagattttagagctaaaatattctttatttgggtattcccatttacctagtgatctgaaaagctgctagtttgagtgggacccataataagggagggttttaggggaggtccagattgctgtgcaagctactctgtcccttgggttgtatgatccagtagatccaatggtgctcaaaacggcagtgacaggcattctgtttggagcctttgataggttcctataggtaaatcatagtacaggcccttaggaacaaaatcttgccatccgctgtggctaactatgctccttttgagaaacagctgttggtatgttactggaccttagtcggaactgaattttcacatgggtgataattcaaccatgtgacctgagtttcccataatgaattagatgttattaacccaccaagtcacaacattgtaccttacatagcagcacttcatcatcaaatggaaattttatgtatgtgattgggcttgagaaggccctgaaggcacaagtaagttacataaagtggcccaaatgcccatggttgccacttctgccacactgtcttctctctttgagcctgcatctatggcttcataaggagttccctaggatgacatgaaaaggaaagaagacttaggccaggttgttccctgcgcttggaagaagaaatggccaaaagggcaatcatatatggattcatgggctgtttctgtagccaatggtttgactggatgatctcagacttgaaaaggatataaattggaaatttgggaaagaagtttgtagatagacctggctccaaatatggcaccattccccagggtgatcagccagctagctacctggtggcagattggttacttgaaacattgtcatcacagaaggggcatcattttgtttttaataaaatagaaaattactctggatatgatttgccttctgtgcatgcactgcttctgtcaaaactactatccatgcacttaccaaataccttatcaccatcatggtattccacataacactgcttctaataaaaaaacaaaacaaacaaacaaacaaacaaacaagaaaacctcatttcatggcaaatgaagtgatgcattgggcccatgctcatagatttccctggtcttaccatgtttcccactattctgagatgactggtttgataaaacagtagaagagttttctgaaagctcagttatagtgccagtgaggtgataatatctcacaagagggaacaaggttctttagaaggctgtatatgctctaaatcagtgtccatagatgagttatttctcccattgccagaactcatggtccaggataggaagagtagaaatagaagtagcaccattattcctagtgacccactaaaaaattattgctttttgtttctgaaaccttatgctctgctaacctagagatcttagttacaaagagggaagtgcttccacccagaaaagaaaaaaaaaaagattcctgacacttagttaagactgccactgggtcacttagaactcctcatgcctcaggatcaacaggcaaagaagagttactacactgcctgtagttattgactctgactactagagtagattggtctactgttttacaacagaggtaaggaaggctatatctggaataaagatcattgaaagcctttcttggtattacaatgctctttgatgaaggtcaaaggaaaacagaaaacaactgaatccagtcaagactactaatggctaagtttcttcaagaataaacatctaggtcacccaagatcagctgaggtagttaatgaagccaaaagaaatacagattgggtagtagaagaagcagggatttatcctaggtcacagccagctgtgaccatgtgactagttacagaaaaagataactgtaattgacatgagcatttccttcttattttggtataaatatgtgcatgtttgtataaaatattttttattgtctctcttatttcctggtcatgtaacataagacatataacaaagtattgaagtattgttaattttacatcatgacaacaaactacatgtttatgttcccccaaaattcacatgttgaaatcattgctcctagtgtgacgccattagaaaatgaggccactgggaggtaactattagacataagaaggtggagtcctcacgaatgggattggtgcccttacaaaagggaccccagggctgggtgcagtggctcatgcctgtaattccagcactttgggaggccaaggtgggtagatcacgaggtcaggagatcaagaccttcctggccaacatgatgaaacaccatctctactaaaaatacaaaaattagctgggcatgttggcacaaacctgtagtcccagctactcaggaggctgaggcaaaagaatcgcttgaacccgggagccagaggttgcagtgagctgagatcatgccactgcactccagcctggccacagagtgagattccgtcaaaaaaaaaaaaagttaattaattaaaaaaaaaagcgccccggaaaactttttttcctcttctgctatgtgaggatacaaggagtcagcagtctgcattccgggaaagaacccttacctgaactcaatcatgctggcaccctcattttgaacatctatccttaagaacagtgaaaaataaatttctgctttataagccacccagtctgtggtactttgtcatatgaaaccaaactgacttatccatcatagtaattaagttatgggatatgaagaaaagcaaatgtcactcaatgactttacctcctttttagagcaggtggtgatacattttccactgtacacaagatagatgtatcaagttaggagattcagacctagctattgtcttcatttggagattgagtatgaaagagatgcatatgggtggttaagttaacacgggatggacttacaatgtttatttgtcaattttactgggccacatggtactcagatatttgcttaaacattgtgggtgtttctataacacctggataaggagggattccttctgtctgactaccttttagctgggacaccaggttgttttcttttcttttccttttcttttcttttcttttcttttctttttttctgccttccgtcttaaactgaaagattggctcctgggtctagagcctgttggcctgtggactggaattatagctttggctgtcttggatctcaggcctttggactgggagtgttatggcattggctcttctggtgtagactgcagatctggctgcttgttaacctgcataatcatgtgggtcaattccttataataaatctctttccatatatattctatatatatatttatagaaatttatatatattctatagaaatctatatatatatagaatctatatattctatatatagaatatatattatatatattttatagaaatgtattttatatatatatatctcctattggttctgtttctctggagaaccctaatacagcagctcatatctatatattacattattcaaaaattattttttctaataatgccattcttttgctgcaatctttttggatattgactctactttttatttctgaggatcaatttcaaggttattcagtgtggcataaatgtattcaccccagttactgatagggttttgtttttaatttgaattaaacacaaggcccaagtcagaggagtttactttgtcatgctcactattgtatataatttatcatttgttgctgactcttctagtcaattcataattgtttctattgtgccagatgacatgagattgtacaacagttctgtgaaatatactacatttactaccactcagccattgagttttattcaaatagtatctgagtctcagatgtcatgattaactcttggtcagtcatggctctaagagggtcctatgaggtgttacataatatgatacctgtggcccagcccggtggctcctgcttgtaatcccagcactttgggaggccaaggtgggcagatcacctgaggtcaggagtttgagaacaggctggccaccatggctaaactccatctctactaaaaatacaaaaatattagttggatgtggtggcatcctgtagtcctagctaatcaggaggctgaggtgagaggatcgcttgaacccaggtagtggaggttgacaatgagccaagatcacgccactgcacttcaccctgggcgacagagtgaggctctggctctataaaaaaaaataataataacaaataacaaatatggtacctgtttacctcaagatgtctgtgcttagggctctctcttcctgcaactttctttctccctgactttctcatagttatttcccttattttttctagatctctgcttaaatgtcatttccttagagttctccctttgctatcaatctaaaatagctttctactcaccatatcatcttctcctattgcctcactttattttcctttgtagcaagtgataacattaggcaacataccacactttccctaacttatatttttcagtcttctccagtaaaattttagcttcccaaaagaagacaggctttttctttgttcatctgtgttttcttcttttttttccctagccattcccccaaaatagttgcatgtctgacaagcagtaagtataacaactgataatattctgttgggtgaatatatgaatgactaaatgagtgaataaataaacttttattttaagtactcatcaagcatcctttaaataattctggcatcatgttaaaatcaacataaatccttcccatttttttaaatgtagacttacataaacctttcttatgtgacatcttgattgtttacatcttgctaaagattttgtaaaaagacaacgtgttcattcttttcccaacatgatttcaattctataattttgacattcaccagcccagaaaatacaggagttcctcagattatttaattttcctaggagacaatctctgaataatgaatacctcaggaaaggaggctttcctagagcattttcagtatcacttggaaatagacccaggatagcaaccacttatttttttgtggtatcctcttataaagtcacttaataaagtactggataaaagaagtagatttatattatttctgctcttctcagaggagctttattttagacttaactgacttcccctacctactaaacagcatctctaaaataatgttactaatttccagtttgttagccactcttccaatccacaaacaatgactcattagtcaacagaacatcccttcactcagcccctccctccattctgccatcgacgccacctccagcactgtacaactactgagtgttctcactaggaaatgcgtttattctcaaaaacaaatgtctgtatcagacatgttgggtgaattataactttagtttttatgtagtaagtatattttcaagatataatagctaattagaggcacttggaaattattaatagtgaagttacctatttgagcaccctgacgtttcacatagaatgctagtttcaagctatactaagaaattaatgctgtataatttatatcataaatatctgtagctgtaattttttcttatgaatttaggtttaataaatatttgtaagttacttttacatgatttcatttttttaattcggtctgtgggggatataattttcacatacttgtaatgtaaaattacaatttccagtgctattttatgatattaattcatctgatacatagaaataataacacctggctgggcgcagtggctcacgcctgtaatcccagcactttgggaggccaaggtgggcggatcgcctgaggtcaggagttcgagacaagcctgaccagcaaagtgaaaccccgtctgtactaaaaaaaaaaatatatatatatatatataaatcagctgagtgtggtggtgtgtgcctgtaatcctagctacttgggaagctgagacaggagaatcgcttgaacccaggagatggaggttgcaatgagccaagatcatgccattgcactccagcctgggcaacagagtgagatgccatctcaaaaaaaaaaaaaaaagaaaagaaaagaaataataacacctaactattgaggtaagttttttttgtcatatatatgtatatgtacatatacatcattaataaagtgatacttggaaaatctggaatattatctataccacctctcattaagcaacattattaagttaacaatcacttatattttgttttctattttgagtatattaatttgatattcaactactcttattagaagtagtatttgtaagtaaaactagcaaaattaaagataaatgttaatattcaacagaatatttcagatgtattttcactataattaacactaaaataatttccttttataactcacaatgtatgtagttcttattgtgggataattagtctctgtctagtcactgaaaattactttgaaatacagttttaaacattggaaatagtgtcctgagcttgtgtgttatgttattttcttgtatttcagaaagatcactctcagtataactctgtgaatgcttgcagctgcacacttttgaaagatcacataaatgtacatttgaacgtgtaatcattcttgcatatgtcagtactttacttgaaatctcaactaagaaaggataaagccttgatagtcacatatagcatgagagagaaaaaccatatatttctactaggcctcatatcagaaagagaataggtatggattgaatactaatgacattggggacttcttttgaaagctcataacagatgaaccaggttctgtaagttcttctgaaggaaaactccatttctagataaatatgtctcctagtttttacctatagttttgtatttctaattttatttagtatttgggtaatttaaacatatttaaacagtacatctatgttaaaattttttatccattcatctgttgatgcataataggttgattccatatatttgctattgtgaatagtactgaaatgaatgcttaatatgtggaatcttaaacgattcaagtcatagcaacagagtagagtgactgttacagaggatggaggatttgagtgggggtggggggtgatgattaatgaatacaaaatttcagacaggagggaaaaaaatatatatatagttctatggcacagcatggtgaatataggttaataatagagtattaaatacatttcaaaattactaggagagtacatttcaaatgttctcatcacaaacatattaaatatttaaggtgatggatctgttaactagtttgatttaattactccacattctatttataaatcaaaacattgctttgtacatcatacatttataaaaagtaccgatttacaattcaacaaatttctaacaatatactgaataacaaaatgaactaaaattaaataaaaacataacattggctcttaaaatgtctgaaagtagaaaaaatagtaatagttttaaaagtaaaacaaaaataagttgttaacacgtgagcaaatttttaagtatgttattgtgtgcaatgctgattttcaaattttactacatgattatagaacagaaaactttaacttggaaaatatagccaatttttcataagcactgtaaacattccatactttctggggccgaatgagataatacatttttactgtcaataattgatgtcacagatattaacaaaatagctcactaataatggctttccataaagacatgtgcacattttaactttatattctaggtacaatgcttttgttagtattacttcattgctctataactataatgtttttattaataaatacagtagcatttgtatactgttgattattggtcttatttgtacaattaaatggctcagtctgcagagtttcttaaattgtttcatttctcaaaaagtttcatgtaatttagcatattttctccaaatgccattcattttacaggtaggcaaaattaaatatatatacatccacatgctaaaatttgtcattttagtgactgcttatatgttattagacatgtctatcatcttgcaaaatgcataatttaaaaaatttgatatttgttaatatactacattttcaactacccaaagcaatactaatttttcttttttcccacaaaattaaaacaatatgactcaatattatttgttagttaatatttttcctatcagaactccatagctagtgttctacttgatctttttggcactgaactttaaaaagaacaagtctcattctgtaataattttatttttattttaaaaaatatttcagctcatgatgttaaaccagatacattgatatttattttataattccaaatgataatatcagttgtttatatggattagaaattagttttatatcttacttttgattattatttgttagcatttagtagcaacatttatcaatatggtggcagttcattgtcgtgactatttgttaataacatcttttattttttctattttttttacatttaaaatattctaaattcctttctcatattatagacttgacatttgtaacactaatcccattctttactgattttaatggagattattttactatgccaatagtaaaatagagttactctgttaactctacttttctccaattttattcaagtggctattcatttttacggtggtctcatttcataacctttttttcacagtatctatgcctttttaagaaaacatttgtgtcaagctagctttctcatctctagcagatctcataaagaattatacttttcagtgtcaatattagtttctattttggtttatgttgcaaatttttatgggctgtatttgagctttgtatattaagtgaattaatttgtatgagcagaaatctgaacaatctaaataattgcttacaaaatagtaggttatttttattttaatcttcttgccatttctgtggccactattaaaatcttacgtgatctaaactcgattgactgaatgttatatacgttttccatcaaagcgatgcaccagtactcctggaagagttgaaagattctggagcgattgctttctcacctgccaagaattgaaatggcacatttcctgtgtggctgtgggctccagttagcctctgttctgttgctaggttcatgttgtacactgcgcaatgccctagccacaaactttggggaagctaatggctaccagataacagaaaatctatcttctcaaaaagaagtctggccaaattttgtgctttttattttgctaaaaataacttatgtgaatatcctgcttctgccattttgtttttaataatacattttgcctgtctcagttgccatatgaaaaaagctactactttttttttgcaggtgatttttaaaaagtcagaagctgttaagtataccataagaaaaaatatcattttaaaaactatttttaccatgtatgcttataactattaaaattgaaaagttaatatctattatagtgaatattatctaatgctatataatgagaacccacctatgcttctctgaaaatatcctggcttacagatctatccagcttgaacttaactaacataactccaatcatcattcatttttggtgtataaataaaaaaggaaccacatagctaaatggttttaaatgtataattaatcactatggcctcattatacttgataccttatgccaaggtaaatacaagtatggaagaataaacaggttgttaacagatgaatggatggatgaatccataatacataactttgttgaagcgtatttaaaaatacctaacttattgaaagattgtttgaagcaataagcttagatcatcctataacttataacatctgattaatttgcatgtttacatagtgttcatgtaacaagaggtattctatttgtaatgaaataaaaacactaaaatatctttaaaagcaaacaaatctattttccttctttcttaaacatgtgcatatttattgtaagtgtttgatgttttctggctatgtttttctattaaaggtcttccctgaaaaaaaagaaaaaagaatgacatgtaatggaagctttcaaagtgattgttgatacgtggtatcttttacaaaattgagaaatatatgttaaaatttaaaacatcaaataaaccctttgaggattgtgtttaaatttgtgttattttctgctacattttgtggcctaattatgtgaaattttactctgcaattgtattttgcagctattttactatgaataatttgcatttttttctattttccatggaatttaaattaaagacaatcaacttttcatttatgagagcagggcagtatcacctttacattgtagcaaaaataacaaaagatagagaaatcacttagttttctgagaaatgcaaaaaatgtatctttcctctcttgcatttttggatgctgttttataatgctttttacatttagtcagcatttttgaaaattgtatagattagaaatcttttaagaagtgccctaacagcaagaaaagccatgctatcttctattcataaaaaagatcattttggaaaggtactttccttcagcagcttttggaggctgtttatataatgtagctgcaaaataacattttcagataaattttaaaaactacaaaaatataaattgtatagtgtcaacaaatatgactgtattaaatgatagaaaatgtcctaagtgtacaaatcgagaaatattactgtcatatcacattgaattataaatgcagagctaacctggtatctgttagaaagagaatggaatttgacaactatatcatttaacttataatggtataaaaaatcaggagaaaaagttccccaggtattgtaggaacttacacaacttttatcagtattctggagggtgaccaaattggtagttcactgattattttggccttcacccatcgtgaggttgcctaggttaacaccaaaatttttctgggttagcaaagctactaggtcacaggagggaaattctaaccaatcacttccatactatgccttaaaaaatctaaacacagaaattatgttagaatttgcagccagaaaattaattctcattgaaaatgtgtcattttcatacttagacctgttcattttaatctctattctcatttactctcatttagttatttctcagttgcttgataattaaaataattatacagtatgcatatatcacacttccaaattaagctggccttttatacattatctcaatctctgccaaatgtagacttgtctttctctcacttctttcttgtttacagttaccttgcatttcatggagtgttggaagactcagtttcatcccattcatctttcaaggatcagctcaaatattacattttctaataacacaggcaaaagtcattgactatccatcaagacagattcttgattaaatttttaaaaatacatttctacatgtgttgaattaaaaatcaggacctgtaacccacagaaatatacatatatcttcaaaatttaacatgtgatgtctttaatgttgataaaactatattatccatgtacataagttatagaaatgaataccaaaaattctacccaaagaataacagtaattctttctttgagagtactaaaaatgttctgaataaaaagggaagaaaaacaagctatcaaaataaagtctcagtgatatgccacttagttatgctgtgtaaattcacattaaaattaaaaacccacactttaaaattatctgtggtcttgggctgcttgatatttgatttaaaagcagttaattgaagagtagtaattttaaaagtagtgaatggggttttagttttgtatttgttcatttgtatgggtgctgtattgttgattgatttcttaatgggattcttttaacttcaatgggaatgtgtaagaaaattaaattacgtaaagccgggagcagcttataaaagtcttgggctcagtagtgttatcaccttatattaatatattggatttcccgcaggaagctcaagatcctttcagtatttatcctaatagtaaagtagggcaggtatacagaggggaaatagaatgtctatacaccaataatgggaaaattgaaaaaaaataagatatttcatatttagatgaaacagaatcagaaaccaggtctcctttagctactttggtacagaatgaatggtgctcacacctataattttactaccatttactatggaccactccacagtgtagaaatgggctcagcataaatgctaaacatatcattacaaatacttcatgttatgatgaatatatttggtcatttcccttggggtcacttcccaagatggttattttataacactttaatataaatgcttaacctttaaaaatgtagttcttttggagaaaatcccagatgtgcatacaattagaaccaacatcaaatattttgtgttgccagatcactaattaaattcctgcacataaccttttccttcctgaaatgcaacatttagtaaattattttataattatgcaaacaatgttttgtatagcttttgcattttaatgagtttgggagaaaccaatttagaattaaatcagattctgaaaaaaaacgaaacaaaacgtgttgtactaaagagctgccatctaattataataacacacactactttccatgagtctgtaattcctttgccatttaaaaagtcacaaattttctgcttaatttttgtttttttgcctttttatgggaagatgtttaaatatttaaattcacaaaggactcataagaatcttccaaagtgaagaaaaactgttctgtctcccataaccttttcttttatattacctttcaaaaaagtttctagagctcctatattctatttggttagattagccttcggtacactcaaagtccagggatcaaagtaggcaaaaatataatgcccaactttatttccctgatttcatcaataatttcatcagacattgtatagaacagtattctactaataggactaaatatgcattagttgttaaataaaatgaaaattatgtagcagaataattatcttgaaatattggactttttaaattcgttaaatatctttagccctctttctatttcctgtttttcagaatgtaaggagtataaatggacctgtaggaaatgacaaacttatgtctgagggacaaacatattgacaaacatattatgtctgagggaatcctataaataaagaactggagtgaatagctgaagttctgacaaaaaatatgggaaatatttggtattatagctgtctgagtcttccactgaattctttgtaccatggtgtgctttaaaaaaatataggaatggacaaagaggagtcaaagttattataggactaagaatacgagatagatacaaacaaacacatatgtatatatgtgttcatagatacaagcacacacatgtgtatttggtacagttctttcattttacttaattaaaattgacctcctaccatcaaacatcttttaagtataaaggtgaaagaaagaggtaattagagaatggagaattcaacacacgagagctgcttaaaaagttaccatacatatggcaaaagacactagttggaatttcacaaatgtaggagataaataagggcaataaaatagtacaatgtgagtaaatctaatattggatgtataaaatgataacaatgtctcctgctattttaaagatatatggaataatacatatgcacatatatgtgaaggggattaaatgtggttaaatatttatgacttttaccttgtctggaacgtgtaacaagtaccaatttctattaaaatatggtaagctaattaaaagtattgcaatccctaggttaagcacttaaagagtagtaaaggtaagtgttaatatcaataaaggggaaattggacagacaaaataatcaattgaaaagaatacataaaaaggaaaaatataacatagaatggatgaaacaaataaaaaacaaatagtgttggcatatatttaaaccttaatataaactaactacataaaatgaaagtaggtgaagtctccaaataaaagataaaggcaaaagtagtatcccataaatagatttaaataagaaaatatgtttattttatacaaatatggattaaaataagaaacttttaagtatatgctaaataatatagctcaaaatttaaaaggtaaaattttagaactacttgaaacttattaaaaccaactggcatgaggacctctaactcatttatattgggtttgtgtgtatgtatatacatttatgtttattataaatagatgtaaatgttatatagtcaaatttccaacatttagctacactttaaaaccacatgggagtatggtatatagattgaaacactgagttttttcttgaggactactcccaaatatgtggatatgttatatttgaggtggcatcaaaatactgctttcggaaaaatgtattcagataattcttacccccagcctgatatatataccacagaaaaagacattttgaagtatatgcgtaaggtaaatttcttccaaatatccaagcactattcaaaaattatcacatgctaagccaagcataacagatgagtcataggaatccaacattcctaactccttcctaaattcacacattactaacaaatcatagcagtatttctgccaaactttaggaatttttctcagcacacttcctttcagtcctcttggtaggtgctagaaattctctacaattggaagaacaataagaaataattttacatttctgtatttttcaaaaaaattaagagcaaaaatataccaaaaagcaatgattagtaatcatgttctttattaatgatacattaacactgaaaattagtaccaaaagagtaaaaagtattgccaagtaaatttagaagtcttttctttcaaatgccatatttactcataaatggaaatgaaaatcaagtctgaaatctatttagaaaatagtacaaataagaaactttaatttaatatttttagaatacaggcaaagcaatacccaaagtatttgtagctccaaacttgttattattaaacaacagacagaataaaaaattgactaagggttaacaaaacatcaaaaattaaagaacacaaagaacaaagcattgtaaagtttagtaaagatggagaaaggactctgtcattaaacatataaagtattaaacaaaaatcagagaaaaccttgagaataaatctatgaaaataagttcttgaaaataacaatgatatgcagaaaagtctaactattataagagaaaatacaaaagatgaaaaaaattgattttgattttatgactatatttttttctcatgttttattagtttttgattggaacagctagaattttgcatatcattgaattgttattctatgacaattatacttttaaatgtgaatattataagtaactccagtaatatacattagcaaattcttagcaaatcctaaggaatttttaaaatgtttgcaaccattatgatttatctcactttatttaaaacattttagagtttagagtcagaaatactttccatatctttgtataaagtcagcacaagattgtaaggccataaacaaaacttctaataaacgcatctaaaagaccaaaattgttagtgcatcagtgtgtgcaatttgcaaaatctttaaaaattatgaaagtaaaatgtcagtttattaaacagctgttgtgctaaattattacttccccttctatttctatttaatgtgttttaattagaaatgatatcatcttatttatcatctccttaatatcaagccatcaccatgtttaatgatagtgaaatctaaagtcctttgaaattcaggaagaaaaaaaatgggtgtttactctcaccattaatattgtactttgtcttagaaatttgatcaaatggtattaaacaacaacataatattagttaagtaaataataaaaagaaaataaaaactacctttatttgcagatgtaattctctctagaaataataagaaaagttgtatctttaaattataaagcactacagcaactaagtaagatacacttctcaggaaaacatggttaaagagcctgtaaaaatttcacattgtaagcactcaatctttttttgctgctgcaagaagtgaaaatcaaaatgagatataatctgatatgttaagagtggaggaaagtcaaaaccataatgattaataattggcatagtgaatgtgtaaaccaaatggtcctcctgcacactgttggttgaagtgtaaatgaggacagagaatttggttgtaccaaatcaacaaccactcacatgttttttttgatttagcaattttcttcaagttaggtacatgcagttacataaatacttcgaagccataaaaagtgaggttgtatatttatcttattgatatacactgatggtcaacattcatgtgttattttaaaaaaaggaggttataaacatatgtacatgaaatccactgttaacctttcataagggaggttgttctttccatgacatgaatgggtaggaagttgacaaaaactaaaggaaaatgctccaggaggtcatctctgggaatttagggatgaatactccttgagacagatcagctctgtggagactcatctttggagtctactaaaagagttatgttgcttcaaagatgaggctcattttcatgaagaactaaattctcagtacatcgaaagagtaggatcctgcttctacctacatcagagaacttaagccactagctgagtggtttaagagccagtatgtcagaatatagtgcagagtgatgaaattgagcttgacgtgatcctacaatatgtcttgaaagccctgagcagatacaaaaggttaatggaatttttatgaagagagggatgtacatgcagctccatgagagacagaatatactgggataagtgataccaacaaaaaaacatagtgaatttaaggcacaaccccggtgactaaaaacaaaatattttctgaaggaagactacaatatcatggcgaattttggggaaaaccataaatacaagcaacgggcttatataatatctcctactttctcctcttaggcataaattacaaaagaaaatatatacaaaataaaagcaattacataagatataaaatcaatgttatttgtgcattggtgtttttaaaagatcagaacacaaaataggctacactataaatttgttttctgtaaaactatccatgaggtcttaacagaattggtgattataagggctaggttaattaaatgtctattcaaagtatagagactggaatgtcgaaggaagcaatcaagggtaaaaatcttactaactgggtcagttttgaacacccaacatgaagtagttcaattctaatgtggacgagatagtcttgggcagtgtgatcactccagtgagtgttctagaagtacgaaggcacctagaagtttctctctttgtatataactcctttgtatataaagtaccccctttaggtacttgtagactgctttggggaaaatgaaattataacctgaaggaatatagtacaacagtgaaaataaggcatcaataactggcactgtacagtgggagctaggttccagctgaaatgcaaacgtggttgaaacatactagtacacttctacagaaataaaaattagcagacaaggaaaggaaaggggcctatggaaaagaaattaatcctggaatttaaacagttttgtgttgccaaggtaacttagacctaaaaatagaataaagttgtctggttggcattttggagaacagagtcataaagatttgcaagtcaaatttataatatataagattgtatcagaaaaggagtttgctttaggatagcagcctcatggaaattagatgaaaactaacaagtctatcaataaggcttatctcagtctcatctcaaacaggaaacggctgggcttgatattgtctaagaacttgaatcctattggttaaaggagaacttcctagacttctctggtaatcaagacaatcataagaaaagtaagatgagaagatggttactcaaatcaagaaggacgataaacttgcatggtcttattttgaccatgtaaaaattttagacaatactagtgctgaaagtgtcaaaaggatgagggaagaatattaactaaaaaaaaaaaatcaattttgagttcattactaaaatattatagatataaataacactggaattgcaaaaaggttataacctgaaaaaacacattctttgaaattatttccagagttaaaaatatttggagagtttcagaaaattgattggaatcagttttaaatcctgtaggattcactcaagcatatggccttaccaaatgaatgtatcagcttcttcaagaactccagagattagtggttttctgcagagaagattggactagctgctttcctcatgctgtgtttcatggtagttcacactcagaagtgaattttacatcttaggatccatacaactcctcttcattaacataatttactgggtttagaacagttttcttaaagtggttcacagatcagcagtgtaaggatcaccccagacatgctggacgctagagctaccaactgagaaactcctaacgtggggccaataactggtgttgtaacaagacctccaggtgattctactaacataacgtttgtgatcctctgggctggagatacagagactgacatttaatctggaaatttgaccgtaaggctaatacttccaaaaatgtgatggggatcagggaaataaaaggtgattatacttgatataaaaagccatggttacgttgtttttaaaatgttaacaaatgccttcagaaagcacatgagtttggagacggagggagagaaagcaaatggaggggggaaaagagacagcaaggagaaatcaaatggaaagggagaaagggaaggaggaggatcatatgatggggagagaaaccaggtggaaacggagaaatcagatgggaagaattcaagatgaagggagatacaactaacagaaggaaccagatagaggaagagaagggggctggagagaaagaggggcatctactttaaactgcccccaaaagattccactttttgtgggattaactctgcatccctgggaaagtttaggcagatcagttcctttacttctcactgtgtgaagagtttagaagtaggactgaactgaggaaagccagaggattttttataattcagtggaaagaaaaagacacaatagaaaatacaggccttgcttataatatgggcctgtgaagcttgtgttgggtttaatttgaaaagtgaaagaaacataatagtgtttaaccccacctggagaagtaggccataccaattttatattatattccagtaataagtattatgtatatatgtggtaaaactatatagtttatacacaatatatatttaatgatcatataacgtacaaccaatatagagttgatataaaaataatagatgattcattgatcatgtttgcaaatacacatatgtatttagccatgcaaaaggattatggcaaattacatattctgttagtaatggcattatgcagagttaaattcattctttattttatgtaaaattactgcttaactatatatttactgatatttggaagattgttaaagaaatgatatatatctattttctaagacagacacctatattttaacaatgctagcacatttatgcaattttatttttacttagaatatgtttgaatgtgaagtaatatgaccaactttttagcaagcttaccagaatttttgcgctcaaatttatttttgccttaaaaaagctaatctggatggctatacatttattccaatgatatcaccatttccatttttggaatttatctttaaattgcttccaaaaccttcaacatattactttaaataccaagcagggaaaatatttttcatgttacgatgaaaatccaaataacttttcgaattgggtctgcttaataaaatggaaaatccaactggacaaaacttaaataattttgttttataagtgataatgtaattgtttttctgtatggccactgttctgattttataaggtaatgataataagtttgaaattactataaataattatatcaatgtaagaccaatcataaaaatgtcaggtaattaaatttgaatgcttaatttctgatatttaaccttaaaagctgccttattactacactgaatcttgttctctatgactgtacagagaatatagtatgtttgtgacttcactttttcttaaatgttattaacgtcacggcatcaaactgacctagacaatactgaaaccaaattttattcttaaactagaaaaaattgtcactccatgtgcttatgcagccaaacaaaaggttgaaatgcagtactaagctgtttaggcaaaattatttggagcttatggctgcctgtttttcccttcagacctttgacatataccatcatattcccaatgcttcagcctgaccttattagtcttatttgcatgagcaaggctgtgtagtcagattaaattgcccaaagaagcaatcctattattcaagtgaatgcatttttttttttactttgccaaataagaaatgagacaacaataccaatcaatagacacatttgagatatatttgagatatatcaaataaatatattaacaacattatttactagaaaatttaatttatcaggaaaaaaaaaacttgcctttaaatcctgggacacacttgcggaagaaatatccccttaaatgtgtactagttgttccatttttgcaggacgcagatttgcagtcttcagtatctatctcacagatgttcctttcatatctttgcagaccgctacagttacaattgtgcgaaagggccaggcagaggccatgcactgatatactgtggttccctaagcaatagtcaacattgacaacacacaatctgccaatgtaactaagagaacagctgcatctgaaacacagagaaatgaaaaacccaattagtcatatactttattttgatatatttaagtatttaaatcacacatttatttaaaaacacagaaataaatatttaatgaagatagttgtggggtgcatttaaaaaatattttcataaagtgtccattcttggcaaaattacttttgattactgtgcagaattatgagtgaaaataactttggtgctgaatatatctagtctcaaaaacatattctgccacttaattgctatgttagctgggataacatcatgaactctgcctatgctaatgtgtgtgtctgtgtgtgtattcatatattattaggttggtgcaaaagtaattgtggtttttttcattgaaagtaatggaaaaaaatcacaattacttttgtcacaactatatatatatacatatatataagattattcaaactcagtttgtcactcaatgcaattatttaagatgtagctgtaaggcaatgccaggtattcttatattattctttaaatctataatattttgaattttaaaatatctgtactcttgaatacatgaacataattcatgcattcattattttagttttttagatacatttttaatgaatttgcaaatttcgacgagattttcccatagtaatttcaatttatccaatatatttttctagtagttttttacatagttttcttgtaagtgaagacaattgtgaaatagtctgcaatttatgtaaatgtattttaaatatattttaggtttaatgttgagaactatgttggctatcaacaaaagtggggatatttttctggagttagagagacaaagatttttcactttttccttcctttcaaatacagacgtgcacagaaacacacacacatctgttcaaggcctaatttatttgatcattatacattgaacaacttttcttgggttcctctatatctaggcatagttataagttattaatataaattcttagatcattttaatataataatacattatataatatatccatatgcatttctttgaatattttatatacatacataattgaaaaagaaagcaaaagatgaaaaaaaattaaagtatcatgattttcaagaattctttaccaagcattcaaagggcacttaacattagcatataaatatgtcaatgggctgagaaaagcaatgtcaaatcactttgcttgttattattaataaaaattaacctactgaacctaagtcattacacttataactgtatatgacggtaagcgtttggagccagcaaaaatgttaaaggtgaattagttcaagcctttcttcttgtagttgtaaagaacttagccatttaatgcaatttgtcaaggatcactgagattattaacggtaggaagtgtagtggatgctttgatgtgttcaaatcactggtcttggagagaaaactttggttttaattcttttcaaacatgtattaaataaatatatttgtgcctgttttctcatctgcaaaattctcagctgcacatctatttcacagaagagtattgaatgcattttttactgggcaagtaactgttacctactatatcaaacacccttccaacaaagttacctgaaataaaatcatagaatacagttacttcccttcaatacctttcctcttctccctccacatacagaaaaagaaaaaaaaacctaggtaaattcaaaacaactgccacatggcaaaaaattgttggcctgtgctaggccttgtttaaccgtatctttgtaaattgttaatagtgctctttcacttttaacagtgttctgattggggtggtagattacacggggccctatgtataatgccaagattattacatagttctgtgcctctactatgcaagctttagtcataatgctgtttgttattccatgaaaatgaaaagaaaattgtagaaagttccttcctaaatgaacaggatatcctgtacaagaatacgaaggcatatctttataattcttcctgagctaatctctagtttattaaatctcaataaaggcatcaagaggtagactctaaattatatatgggaagcttacggcattgagaatatttttgaaaattaagagtaatatggaagtactagctcagatactataacaaacaaaaactgtactaattgaaagagagtttgccagttaactattaggatcttgctgaagtctctaatctgaactgtgtggagatagtgacaccttttattaagaggaagatttaataggagaaaatttggggtagaaactaggaatctgcatttggccatagcaaatttgaaatggtaattgacctatttttatatttcattatatttcatgtatttttatattgaccacttgatgtttgttttattgagctttaatgtcctcaagagaatactttttcttgtgtactcgtctttttaaaatttgacgagttgtggttagagcaacaacctacttgttcccaatttttgaatttttcaaattttatttttgacacaacttaggcacattcccttattgtttagcattaccatttctatatcaacctacctacaatacaaacctacctacacatacatatttatatatatatatatttaaattctcaaaaatgattatatcttagtaatatataatgctctgaaattttatctttccatttaatgatatgtctgagataccaatccaaattagcacattttgttttcaaaggttgcaaatattctattatatgaatgtaccataatatttcaccctcagaaggcactgtagttactatgcgttttaatttgttgtgttaatatttatacagaaatggaagtccttgtacaaatatatcagtggattctatagagaggatccataggataaatcccttgcaaaattggccctaatcaaaaggaaatcaagtgtttaattttaatagttcttatcaaagccctctctataaaggttgatgttcagaatgccgggcttcccaaacactggagagttctgcatatcataaaatgttttagtatttgccagtctgattaaaaaatctgtcctattttgctatgatttgtatgtgtttaattcatgaattgcactttttttgcaaagttactggtcatttacctttttgttttcctaataacaacctatttttggtaatttttctacaataaataacatatttttaacactaattttataattagcacaaaagaaaatcagatatcaacacttccttttcctttgcaccacatccttcccctgaccccccccaaaaaacaacttggcagtctattgctttctaatggccattgtttgaaagctcattgggatgttcttaggaaagtgtcgcttctgatgcattggaagtagtccaaaatttctgaaatgccaggcgttttggttttaaatttatttccaagttttaatattctggtttattttaatttatattttcatcaaatactatgtaaatattcctataataatgcaaatatttcttatagaataactatagtgtcttctgagggtcaaatattacagtgcgtttccatttctaactcatcctgccacctatataagatgtttaactatttttgtgttttcatttatctcaatatttccaaataaaatattttacatttattacttaataaaaaagcacatttaaacattattcattgatgtcatcctatggaagagaagtatttacatttcttacactgctccttaccccaaaacacacacacacagacacacagataaacacaccaagcccttatatcattctcccaatataaaattaggttaattttgtaataaattaacattcattttatataattatgtgtttagtgatatcatttgtagctgaaagaggtcatatgcatttacttttacagaacatttttgttttcctggcagtttttaatcactatatttttagttttgtttacttattctaagcatccagtcatcattacttccccatgtccctcaatatgcaaaatacattggatattctctcagcctcagtctttttgtccttagaaatgcctcttctgaatgggtagatccacaggctcacttcatagtgttttctgggatgactcttcaccttcatcctgggaggctttaccgcctgtcttctggtttggatcctcagtttcctaaattcctcatcttttccttacttgacttcctattttaagcgaagtatattatttttaggttagacctcttagaactaaaaatgttcacatattgtagatctgaaaactatttttttctacctttttcttattactttgagggcagtagtcttaagttttggagtttttttcaaaagtttaacatgcatctcttctttgtatttcctctgaattttctccccaccttccaactgactttggtctctggctgtgaagttagagaatttcctaacttacatggttatgcttggctctccacttatattgaaaaataaatcaccaaaaaatatggtttgaaattccatgtattcattgtgagtggttttctagtgactttattgcactgtgatcaaagagacctggctgatttgtttaagaactctctaattctctcagagtctgtattcttttacctacatccactcagtgacagtcaggggaagtggcctgaccacccacatttttagagcagaatagggaaaaataccttgttacctttgttttgggagtagatttttacttaatttctcctctgtagtattgcaccacatccctgggctctgtgtattgctcaagaatggaacaggctgttcgcacagataaaagagagaattcaggagtttaactgtgtgctcataaagctttcaaccaattctttgattttcagctttaccatggtcccaccctcaggaatgactgatgagtacaatgcctgtctttcgagtattcggcttatttagtggcttcccctctgctaccaacttagtttggtggttctagtctttcctgatgctttgcattttaaataatttttgttaggatgttagacactgtaaatattttattgaaagtctagattttgggctgggcgtggtaactcatgcctgtaatcccagcactttgggaggccgaggcgggcagatcacgaggtcaggagatcgagaccatcctggctaacacggtgaaaccccgtctctaccaaagatataagaaattagatcttaggcatcgcgtcatagaggaactacaccttccagaaccctcgcgccctgcgtcgtgctggcacttttaccggccgggccttagagcgcagcctgtagccgggcgccatctttgacgctggcagtcttggttttctgctagtgctgctgctgctgggaggacgacggacggcagcggccaagcgagaagaaagacgtggcagcaagcgggagtcggggatagtgtcatcggttcgggtcccactactttggagcttgtctcaaactccacatacagaaagccaccgaccttattccggtatcctacacccattccccaccctcattacactcccacccctggccctcagcgtgggagtcaagagcaacagggacacttccgtactccttgtaggattggtgaaaccgtaatgacgaacacccctaaactcccataattggtgcggattcctgtggggaaggcctatactgttgacatcttccaggccatctcaaggttctggaccttgagaaggaggctgtggaactagagatagtgatgctttttaggatttggggatattccctgcccaaaaaattcctggaaaattgactagtattaagtgtgaagaaatcttgaagaccagaaattggatcttactgaaaaactgattttttttgtttttcagattatattgttcagctatggaagatggattttttttcatgatcctttgactctcaagttcatctttaaatgaactcttttttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaaattttttctgcttcattattattaattcatggattgagtgttggttcgacctacaggcgtaatagattggaactcagtgaagacacagacgttcctgttgagagcaatcagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattctacatgtaccaaaggtgacagctgcccattccgtcactgtgaagctgcactaggcaatgaaactgtttgcacattatggcaagaagggcgctgttttcgacgggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaagtgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccaagcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgcattttggaataaaaactcttgaggaaattaagtcaaagaaaatgaaggaaaaatctgaggagcaaggtgagggttcttcaggagtttccagtcttttactccaccctgagcctgttccaggtcctgaaaaagaaaatgtcaggactgtggtgaggacagtaactctctccaccaaacaaggagaagaacccttggttagattgggccttactgagacactggggaaacgaaaattttcgacaggcggtgacagtgatcctccattaaagcgcagcctggcacagaggctagggaagaaagttgaagctccagaaactaacactgacgaaacaccaaagaaagctcaagtttccaagtctcttaaggagcgattaggcatgtcagctgatccaaataatgaggacgcaacagataaagttaataaagttggtgagatccatgtgaagacattagaagaaatgcttcttgaaagagccagtcagaaacatggggaatcgcaaactaaactcaagacagaaggaccttcaaaaactgatgattctacttcaggagcaagaagctcctccactatccgtatcaaaaccttctctgaggtcctggctgaagaagaacataggcagcaggaagcagagagacaaaaaagcaaaaaggatacaacttgcatcaagctaaagactgatagtgaaattaaaaaaacagtagttttgccacccattgttgccagcaaaggacaatcagaggagcctgcaggtaaaacaaagtccatgcaggaggtgcacatgaagacggtggaagaaattaaactggagaaggcactgagggtgcagcagagctctgagagcagcaccagctccccgtctcaacatgaggccactccaggggcaaggttgctactgcgaatcaccaaaagaacatggaggaaagaagagaagaaacttcaggaaggaaatgaagttgattttctgagccgtgttagaatggaagctacagaggcttcagttgagaccacaggagttgacatcactaaaattcaagtcaagagatgtgagatcatgagagagacgcgcatgcagaaacagcaggagagggaaaaatcagtcttgacacctcttcagggagatgtagcctcttgcaatacccaagtggcagagaaaccagtgctcactgctgtgccaggaatcacatggcacctgaccaagcagcttcccacaaagtcatcccagaaggtggaggtagaaacctcagggattgcagactcattattgaatgtgaaatggtcagcacagaccttggaaaaaaggggtgaagctaaacccacagtgaacgtgaagcaatctgtggttaaagttgtgtcatcccccaaattggccccaaaacgtaaggcagtggagatgcaccctgctgtcactgccgctgtgaagccactcagctccagcagcgtcctacaggaacccccagccaaaaaggcagctgtggatgctgttgtcctgcttgtctctgaggacaaatcagtcactgtgcctgaaacagaaaatcctagagacagtcttgtgctgcctctaacccagtcctcttcagattcctcacccccggaggtgtctggcccttcctcatcccaaatgagcatgaaaactcgccgactcagctctgcctcaacaggaaagcccccactctctgtggaggatgattttgagaaactaacatgggagatttcaggaggcaaattggaagctgagattgacctggatcctgggaaagatgaagatgaccttccgcttgagctatgagaaatgattgatagctgaaggtggtagtgaggacactttaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcaaacttagtgactccttgaggtgtttgtcagttttggcttttttctcctttgttgtattctttatgtattgtcttgatgtacttaatattacctgagtttgaaatggatgaagacagctgctaccattaaggaccaaattttatgctaccactaaacaaaaatacccactcagtctgtgttagattgtatgtctttttaaaggtatttagagattcaactaagctttaaagagggctgagcagctcaggaagcctgtaatgtgggcataactctttggacctgatcttgatgcttctgctgctctgttggcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatatggttaattttttatttctaattctcccaacaaacccctgttgcccagtatttatgtggtggcctttaaccacctgagggaaaaaatgagcttattcaagctgccaatatttatctatgggctgtagcagtacactgaattgtactgtgccagggatattgagatgctctgggggtatattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccccacctgtcatgttggctcctaaggaactgctgttgtaagcggctcatcaagagttgaacttcacgtagccttgttgggaatatggaaaaggaagaaagccacaggactgcccattcagtcttgttaagattgggatgattctgcacaagcaaaaatgacttgaaatttatgtatcgacacacctctaccaatccatcttcagctgactgaatgttgtatgatagcccttctccaaagcaggggtagaatgttcaggtttcaccacggattttctacttatttcgcttttggaatcagcttacagattccaggtcccttttgtagatattctttattcttttgcttttttaaaaaataaactggtattagtcaatgtttcgtgttccgcattatttgaaccatttgcccttacagaaagagaaatacttgtttgtgttttaaataaaactgatgtaggataaaaaaaaaaagaaagaaagaaattagccaggcgtggtggtgggtgcctgtagtcccagctacttgggaggctgaggcaggagaatggtgtgaacctgggaggcggaggttgcagtgagctgagatcgtgccactgcactccagcctgggcagcagagcaagagtccgtctcaaaaaaaaaaaaaaaaaaaaaaaaaaaaaagaaagtctagattttgtagtcttcctctggaaagccgaattttgttttgccagggagttaagttacttaccattcaacctgatcctttttaagcgtatttttaagtttgggagtatgcgtctagagtaagtttttctttagggctaatttaattatccttttgaagcacgcctcttcaggaggctcgaggaaatattcagggtggtccgcaatgcctccattctggctggctgcaactcaacccccagctcacaaatcccagtagctgtttttgcctggcctcacagagtttcatttcatgcatatgtagcctaatattcaatgaaggactcaggatagctgcctgtatagatttctggagttctttctctctgtgcctcacatttcagctcttttagctcctttaactctgatctctgtctattaaattcagtaagttggatctgccttgtcatggttcctcctctcttactgcagtcttggaagtgcctacatccagaaagccatgttggttctagggcttacctcatttcttttcctgttctgaagactcacacttctgtgctgtgtctgttttctaacgtctgaaaacagctgtctcatgtattttgtccaatttcctagctgtttacagcagagagacagatttggtaccagttattctatcacattgagaagtgatagtccctaaacttgctctaaacatgtttagatttaatgtgaacaactaatgtttccattttcagtttctcttagcagttttcaggagcttcaatccgttaattctcaaatacatccataaatcacttggaatatcttaatgcattgtatgaaagataattcctcctctgtacccatcatcaccactcttcctttaaattgtgggatatgtttttctgagactgtggctttagtgtgtacgagaaaaattcagttgttatcccctcattttggggagtaaaaataataagaatgaggagcattatagtatctaatcttgtccaacaaaaacctaggtaactttggaagttttcttctctctcccccactctcccacttctatgtgtgtataagtgtgtttattgaataaagagccttttatttttatttatttatttatttatttatttgagatgatgtctcactgtcatccaggctggagtgcagtggtgtgatctcagctcactgcagcctccacctcccgggttcaagcgattcttctgcctcagcctccctagcagttgggacagactacaggcacatcccaccacgcccagctaattttttgtatttttattagagacagggtttcacttgttggccaggctggtcttgaactcctgacctcaggtgatccacctgccttggcctcccaaagtgctagaattacaggcgtgagccactgcctcaggctgaataaagagccttttagataatgtcttgcctgacaagtttaaaacaactttcttaccagatatgccataataaaaatctccaagaagttttccttaggctacatctcaatgggccatttaatactatatcaataaactttattacataataagatcttggtgtttatcagaaagggatttgagccagggtgttttaagttggttagtatcttgagtgagaaagatctctgttttcattagccttctcagaaaaaactccccctatttatcaggaatgcaaatgtttcagattgaagtgggtacccagacatagctcaacattgcacaaacaggtgccaaggggaatctgtttccttttctatctaactccaactcctttgaatttttttgacaggtacttagaaaaactgggattgacaaagtgatacagtttgagttatatgttgccatagaaagaggcaagttggcaaatattttggtaaatcatttcaagatagctttgaggaggtcctcaaagcttagtattatacatagagcaagaggattatatgaagtatgaagagaaaatttcttctgattttctaaggaagatattgtttaagatccaagactagaaaaccagttgaataatgtaatagtagtgcttgggcgaatcaaaccttttggtgtgttaagtttaaattctcaggaggatcgggaaatccatggaaccagatggctcctaattgtttacaaggagaaaaaagtcatgcagaggttgagaattgcatggtattaaaacctatagggttaaaaaaattagaaaaaactagtgtggagtttggagtatttcaactggtaatcaaatacagaatgttatgagatagctgatgagatattctttcgtcagatttcctcaaataaataaaggctgttgatggttccatcaagacagttttgcgtgtagggaaataattagcatgtgttttatctccgttaacatatgttcgtaattgcacccatacacttccttagaaggggaaagtttgcaggcctctgaaatgacatttgtacttccatagcagaattcaaaaccaacactatagaaagcatctatagctgccttaaagaaaaaaattggtgaatcagccaagggtgatgggaaacatggggcctgatagacttgtcatatcttgttacaaatgttctcaaaaaagcattattcatgtgcctctgcttcctatgactagatatcagatatcaccaagtctctgtcactgaggagcttatagcttaaaagggggacttttaaataagtaaacacactagtagacattaatcagctcaccaaccccaaaatattggagcattaggaagaactgaattcgaatcttcgctctggtacttaaagtgtgattatgggaatgtgttttaattttaatgaacatcagttcccatctcagttaatagcaaccaagcttcccggtaaaaattctatggttatcctttatgtatctttccccttgcctcttactgccaatttagcagcacgtccaattgatcctactttcaaacagacgtgactacttctctccctttcacagtgacatccaaggccccaacatctattgcctagacaattggcctccagtctacttctacttttgtcttcctccccttgatccctgttcaatttttcttggttgaatagccatattgatcctttcagtatgcattggatcacaatactatcttgctccaaccccttcaggtccctcccattgcactggactatacacactcttggctgggcgtggtggctcatgcctgtcatcccagcactttgagaggccaaggtagacagatcacttgaggtcaggagttcgagaccaggctggccaacatggtgaaacctcatctctactaaaaatacaaaaattagtcaggcaaggtggcatgtgcctgtaatcccagctactcgggaggctgaggcaggagaattgcttgaacccaggaggcagaggttgcagtgagccgagatcatgacactgcactccagcctgggtgatggagtgagactctgtctaaatctatctatctagctatctatctatagatatagatatatctgggattagtggtgaccagcttccaagatgaccctcaatgatcctgcctgcctctgagtacccacactcttgtgaagttccctccctcacacactatgccagggttagtctgtttgactaaccctggttagtcaaaaacaaaaacaaggaaataaaaaaacccaaactcttcagtatgcccttcaaggctccatgtgaccttgtcgtgtctacctcttctgcctcatctgaaccttagctctttccacacccttctcattctgctacagtcatctagtccttactgttctatgagcagctcatttgctaagcacatttcttctccaaggagtggctccatttctcgagtgattcccatttccactggctggtttatcattatcatataagctccatgtctaactcaagtgttaccacttcaaatgggttttcaccatcctagctaaaatagcagccactgtctctcttgctctgttttatatcttcgtggcaatattgccaactgaaattttattattattattttaaaatattatttatttcttactagaaggttagttctgtaatgaccaacttttcctgtcgtgttcactattgttttccaagcacataatcgatacccattaaatatctgtcaaatgaatacgtaatttttaatggggatgatgaataaaatattattttttgaggagggaataaaagaaaataagtatatctataaatactacacttgatcttagccaaaaggccgagaagcgatacgtatatctataaatacttaaaaagtatgaagtactacaatattaatattcttagatatataactaaaagggttggatggtaaacaaagtacttggacatgtttctggtaagtttctctatgagctgggacataagttttacatttaatcctattttctatgttaaaggaggataagtgagttttacccattgaacaaatagacccactactcatatttcacaattagctgctttatgcatatttgaccaacgttgcactttaagcaattacagataacacttagtcctggacttacagatggtttgacttatggatggggaacgcagtagaatattgtgttcccaataatgctgcctatttacaaaagcagagtttccatccttttcattagttaaaagtgaatagtttttactaattaaattaatatttaatatttaatttgtgtcaattaaatatgcacaaattctgcacaaccctcagcccccttttgcagattctgatatgacagttgagtattattatatgagtaatgataactgtcagggccaatgttggaagcaaccatgtgacctactaatacaatatttatcctctgtccctttgattttctgtttagtaggctctccaaattatcactcattatgtatcccaaagcagaaatcagtgtaggtagcattactaaacttagcaaataaaaatatgggatgccaagttaaatgtgaatttcagaaaaatgagtgcttttctggtataagtatgtcctatgcataagtatgtaggggtaccgttttgctaaaaattatttattgtatatttgaaatttatatttagctggatatcatgtattttatctggtaaacatatatataggatatagccagtgacataattcctgatgccatcactggtcctttggctcagaccacagtatttctaatatcagcggagcacagctagattgttcaactgttgcatctgttaaggtggttagaagatggtatttcatggaacaagaatatttactatgccttcctttatctaagtgcctttaatatgtttccttttatttgaataactttgagtgagaaatagacataaaggagagttttcctatgatgcttgactaactctgaatacttcctggcacttgtaagataaacttggtcatgataaattaagtgatcagttattgctcccaaggtttctgtcatctgggtttagggtcagaggtggattttctgtgaagttaggaaaactatagctttagggccgtcactcgcataggtcacttccatggccccatgcctaattttgtattctttttcttaaatacaaaaaaaagagacctcccaaactctataagtgccatgaaaacctgcattctatcccctcatcccccacccatgtctagggataaacagtctagcatgctagctctagataattgctgctttggataatttccagataaaatgcccaaattgacaagacaaatgttttacatgtaaacaagttgcacttacttatctcaggcccccaacaacctgattcatttcagctattggctttttcttttctctatggtcacagttatcacagtatgctctcaggaacatgggggcagagcttcaacgttaaacaggtctttctgttttcctttccactgggagatacctagttcaatgttcctgtaaccagttgtaatatatgccaatctcaaagttaaattctggctctttaggagggagctttcatctgaagacctgggatcttcagattatcactgcgttgtcacttcccctaatttaacagctgcttgttttgctttactccagtcctcaacccccagatgaggtagtagagatcccctactgtttcgtggaacaccagcaacacggacacaaaggcaaactccagctttcctcacacctcttaaagagcatcttgaaccctacaagtctagatggccctggcctattccctgggggatattttttccccataggtagggctggtgagatattatgttggagtcacccggggcctattcttgtacctcttctgtctttctttgggtactttcattcacttggtaatcccatcttttgtcatggctctaaaaaccatccaaatgttgacagctccctagtttatatctgggaaataataggagggtttagagtaaagaagtgacccgatacatgcgtgattaacacatgcttaaaggatcagccccgaattatcccttgactcaaaacttattcaactgtctatctgggtgtcctttaggcatctcagacatactgtgatcacagctgagctcctgatcttgcctccaaatacggtctttctgcagttttccgtatctcgataaatgacaacttaatcttcccagtgtttcaggccaaaaatcatggagtcatttctgactcctctgttattctcacgttagctgttcaaactacctaaataacagtctacctactaaataccctttgtctctaccttcagaatatatccagaatctgatcccttctcagtatcttcacagcaaacacctggcccaggccaccccatctcctacgtggccttgtaattgcctcctaactagtctccctgcttctgttttcagccaactttagtctgtactcaatgtagcagtcaaagcagtcttttcaatacataagtcagagcatgttagttatcctctgctcaaaagcctccaagagcttcccacattaataggaataaaagcccaagtcctataatggcctgcaaggtggtatctgatcagaccctctgcaacgactattgtccttgtctcctaaaattttatccaccacccactcccctccagccttgctgaccttgctgtttttcacagaagccaaacatttccccacttagtgcctttccattggctgttccatctgcctggattgctcttccttcaggtgtgtctatctgtgtgtgtgtgtgtatgtgcatgtgtgtgtgtatacatgcttacatgcttccttacctccttcaagtactttctcaaatgttaccttctcaatgatcaccccatttaaaatcgaaaccccccctccacaattgttaatccttgttttgatttttctccatagcattcattacttctaagataggtttttaaaaattttttattctgtctcttccaattaaatataagctccatgaaatcgggtttttatctgttttcgttcctgctctatcattcctagcactcagaatagtgcctgtcacaagaaatggagggcactcaacatatatccattgaatgcataaaacaggataagaaagtcttaaacatttgcttaatgtgtcttcatcaatccttaaaggttcaaaagcactcaaccctctttctcttctttggacttccccttatggtgtgtgtgtgtgtgtgtgtgtgtgtgtgtgtgtgtgtgtgtgtgtgttttccagctaaaacctaatatccttgagtcacaccattaagagagttgcagctagctcttcagaaatcttgtatctactgaactccaagaacatcatttattcagtacccaaggatgggacatagccaatgatgatgatgggaacattttcaggaactgtgctcactcacatagatttttgttcatggaataagtttctgaaggtctgtttatcagggtaaaacttcagtcctgtatcaactaacaatcccatacagaagggtcactgtttatatttctccaaagcctggtcaaaagtaactttgactaatttgattaaattgattgataaagtaaatcatatcaccaaaacacttctcattccaatgcttgatagttatggaatttgctgagaccacccactgaatacccgttcaaatgaatggaatctcacagagcacacataatcatctctgacttttgtagccatagggatacattaatacctgtgcctcatacttaactgaaaatcaccagttgtctgctgagtagtttactgcatgtcaaatctgaggtccagtgtaatagactgttttaccacttctattcagaattttctaattcatagacattctaattttatttgtctttttctctcaaataccatgatagggtgaaagtttgagcttttgtatcttaatgtttattgaatattaagatacatagagaatactctactatacataaatgcataccattcaatgaattgtccttggatgaacattgctgtaaaactattcaagttaaaaaataatatttccagtatccagaagtcttctgatgtctcctccccatcactactcccttcttcctccccaatgtaactgttacgctcattctaacactggagttcagttgtgtctcttttccaactttctataaatgaaatcatctgtataaatcttgcatctggcttcttttgctccatattatgtttgtgaaattcatctatattattgaatataataactgtggttcattcagtattactgcttcatagtattccactttatgaatttatcacaatatattgtttctagtttttcatttttataaatcatgttgctctgggcattcttggaaatatttttggttaccatgatcccctttctgttgaatatacactttggagtgcaatatctgtgtcataggtatgtacatgttcaactttagtagataatgtaagcagttttcctaaatcattgtcccaatttaactcccaccagcaatataagagacatcctattgctacatatccatgtcagcagttaggattatctctcttctttattttagttattctccttggtaaatagtagtagtatctcattgaggttttaatttgcatttctctgactacaaataagattgaaaatatgcagatatccttttcctgaagtgtccactcaagtatttccttcttttttctattgcattatttatctagttatagttaatttgtaaaagtttaaaaattatttatctggatgcaagtcttttgttagttatgtgtgttgcaaatatcttttctcactctgtggcttgtttttatagtctctaaatggtgtttctgttgaaaagaagtttttaattttaaaacatccaatgtatccatcttttcttatgaacagtcatttttggtcccaatttatcaaatccttacctatcctaaagtcttgaaggtattatctgagttatagtcttagattatcttctaattgatttattattttctctttcacacttttcacagttaaatctacaatcacccagaatggattttcatgtgtggtgggtggtaagggtcatttcttttttaatcgtcaactttttaaaaaaattatttttatactttaagttctgggatatatgtgtagaacatacaggtttgttacataggtatacaagtgccacggtggtttgctgcacccatcaacccatcatctacattaggtatttctcctaatgctatccctcccctagcccctctccccctggcaggccccagtgtgtgatgttcccctccttgtgtcatgtgttctcattgttcaactcccacttatgagtgagaacgtgcagtgtttggctttctgttcctgtattagtttgctaagaatgatggtttccagcttcatccacgtccctgcaaaggacacgaactcatcctttgttgtggctgcatagtattccatgttgtatatgtgccacattttctttatccagtctatcactgatgggcacttgggttggttccaagtctttgctattgtgaacagtgctgcaataaacatacatgtgcatgtgtcttgaattgaaccagcatcatttgttgaaaagactatattctgtgtggatttcaatttgaaaattttatataataaatattgtatctatatttataactatgatttctctttatgtttgtaaggcttagcaattaggatatgctatcaatttatcattttaaggctgattttgtctttttttaaatgtcaaagtatttattttacctcaattgttggaagaactcattggttggagcagctaaacctagatctttgtggagagataatggaaaaaatctgtaataggtgtttgattttctacttaaatctattcactgattactaatttgctcagtttattttctggagtcaatttttagtcatttatatttctccagaaaattatacatttaaaggcatgttttatttttactactataaagctacattcaatattctgttaaatgtgtaaacaattcttgtaaatactgtttttcatttgtagttttggtatgatttttgttttcctattgttacggtctgtatattttataaaatgaatgtctttgattctgttatctattgctgtgaaacaaattactccaacacttagtggcttaaaagaacaaacatttagtatctcatgcaatttctgaggcaaggaaatctaggggcagcttggctggttcaacatctctcacaaagtcacagtcaagcttttcttcctgggctgccattgtctcaaggcttggctggggctggagaatccactgttaagctcactcacttggataccgacagagctcaattccttgctagctcttggctggaggctacattttctcttccttccttccttccttccttccttccttccttccttccttccttcctttctttctttctttctttctttctttctttctttctttctttctttctttctttctttcagacagagtctccctctgttgcccaggctggagggcagtggtgcgatctcggctcaccgcaacctcctcctccggggttcaagcaattctcctgcctcagcctccagagtagctgggatgacaggcgcccgccaccacgcccagctaattttttgtattttcagtagagacgggatttcaccatgttagccaggatggtcttgatttcctgacctcatgatccgcccacctcggcctcccaaagtgctgggattacatgcgtgagccaccgcgcccggctggaggctccatttttttttttaccgtgcagtcctctccatagaactgttcacaatatagcaacttgtttttcactcctttccccttctcactcctcttttccagcaatagatcagagagagagagagcgacaaagacacaaagagacagagagaacaagagagctcaacgtggaaattatactctttcaaagtctaatcttagaaatgacttaccatcacttccacatctgctattgttcaaacagactaaccctggtatagtgcgtgtgggaggagacttcacaagagtgtgggtactcggaggcaggcagggtcattgagggtcatcttggaggctggtcaccactgatcctggttatatacatattttatatatatattatatatattttatatattatatgtattacatatattttgtatatataatttatatgtaatataatatatataaaatatatataatttatatatataatatatgtattttttaagacagagtctcattccatcacccaggctggagtgcaggggcacgatctccactcattgcagcctccgcctcctgggttcaagcgattctccttccttaaccactgaagtagctgggacaacaggcatgtgccaccatgcctggctattttttgaatctttagtagagacggggtttcaccatgttggccaggctggtctcaaactcctgagctcaagggatccacccgccttggcctgcgaaagtgctgggattaccgtcgtgagccactgcgcccaggctggtcatagttttgttgtgaattctatttttttctgatattaatattattttctacttttgatttgtgtatttacatatatatgtttacatgatttttatctttatatttttaaacttttaaaatgtcactatttggctgggtgtggtgtctcaggcctgtaatcccagcactttgagaggccaaggcaggtggatcacttgaggtcaggagttcgagaccaaactggccaacatggcaaaaccccgtctctactaaaaatgcaaaaaaaaaaaaaaaaaaaaaaacaattagccgggcatcgtggcacatgcctgtaatcccagctacttgggaggcggaggcaggagaatctctttaacccaggaagcggaggttgtggtgagccaagatcacatcaccacactccagcctgggcaacagagtgagtctccatctcaaaaaaaataatatatatatatatttttaattaaaacgccactctattttagcaaaacatgggttttgttcattgaatctgaaagtcttcagttttccatagaagaaccgaaaacatttaaatgtactgtcctgatacttggccttacttcttattcctcttattttcaaaaacattgttgaattatatttgtgtctttattaagatgatgtccaaacaggagtttaaaatttcttctgtataatcatggaacattctctgaactagcacattgtagacactcaataagtatttgttgaatcagtgatacagatagatggatggttggttgaaagaggaatgacgccgctttgctaggggaggtgagtgtaggactccctccctcaaagtagtctgttaaacagggaagtggctgcttggttatctgaacaagtattcactccacattttgagctagacataatcattgaaagagagctagaatgccttcctattgacttcctggcctgctgggaatttttgcttccttctcccccagccatccaatttttcaagaaaaattttctgtttgccagcttatttccccaactcccctactcttttgtctttcctaccctctaaagagagtctaggtctcacaggtgatcttttgtagctctgtgatgcctaataatagaacagaaaaggagatggggaagaactgacagaaagactaaagaaaggaattaactagcgagtttaagtggagctgcctaaggatgcaatgcaggaaaaaaaaaacacacacacacacaaaatggatggggactacatgctgaagggactgaagtcaagagggagaatttgggctgcgagtcagccaatgagagattccaaaaggaatagaaagtgctgagaagacaaaagcacatgtagcctgataagggcatggtgaccaggagctcaggtccctcagaaatgagtgtctagttcatgccatcaggtaagctactaagactagcagagctgcagcctgatataggaggaatccagacggataatggaggaaggagatgatgagtatcagttgcagccctgggactggtgcagaagcaggggtggagttcctcctattaacttcccctattgtagatttcactgggaagagatgcctcttggtacagtggaggaactgctccttgaacgtattcaagtggcacatttggctccttgaagtggatccaagtggcacatgggatagatggtggtagaaacagagaagtgcatctcagaaggacatgttgtccttctgccagttatagttctgccagtagatagcctctagggctcagccccttcagggattcttttagctgcagaggtgcaggttaaacaggttgccttaaggtggcccttaacaagtggccttaaacaggtggcctgaaaaaggtggccttagctaaggccaccacccccatcccctcaaaggttggcatgcagtgactgatggagggccatgttcaccctaagtgaggcaactccagcaggcacctacagcttcctgtggagttggctaaggcaatcaggtctgcatcacaacctgacttctccctctgctcaattgttttccccttcttttcacagctgttggtcccaagggataccctagaaatatactaaacgctaaacattgtctcaggtctgctgttggataactcaacccatggcagtgctctgtaagactacggagattttgtgggattaaaactagtagagagtatgaaagcctttttttttttttttttggcagatgcagtattctgagaaatggattaacatgatttaaaatggtggccaagaaatatgattcttcttgtttcattggaaggcctggaagtgtaagaggctaaaatataaaacagactgggaatttgtttcaggagtctaagaataaaatccacaggctaaaagagggttgcagttggagggaaaaaatgtacttgctatttttcaaaaaagagttggaaagatttggtgtcaacctggatgtgaggatgaagacaagccagctagaataaatattgattccaagattgagggcagaggtttctgggagtgtcactgatgggaacagacaaaatggaaaaagacttaatgaagaagataatatcctcaagttttgacatctctaatttaaaatgtcaacaagctatttaagaggaagtttctttgtgttgggagccaccttagttgtccagccatattaaggggctgcaatacagtcatgaaggctataaccagcactatggtatcatgcccagtctaaaatgaggctgagctctgaccaatgtgggggctgcatgtgccaggaagaaggggtgccttttctgactggcacaaagatgttgtgtgagctggtagggggcctggccattgcctcaaaatcagtgagagagacaatgtgatgtctggtgaaatgcacaaatttggtttagattagagatggaaagttagtgaaggagaaaaggctttagtaagttagatttctttagggtgggagaataggcaagtcacttaaaccttctgaatctccttttccttatttgtgtggcaggatgcttttcttttctccactccctcacagcttcctcgtaccaagatatgatagctgaatgagatatttggcaaggcagagaaaagagatggagacgcttagcctaattaatgtgctacacttatgccaagaagggattctatgcttacctagcagataatttaccctgaaactggactaggcaggtcacctttttcttcattttattcttgcatatgcaagatctaattatccagacgtatccacagagagaggaaccagatgaaatgaggaaagcacggttcaccttcaagagaaagaagtaggactctggggttttaagccgaggcatgaaatgtaccgattaatagcgtcattttggaaacacaggtctcaggagttttgggaaggttagtatgagcttgtcagcattgcttatgaataacagtgagattgctgctttgcacctgatctcagtcagacctcagaggctcagccactggggctggttatgcagcaggaatatatccatgcgaccagcagggtgtaagaagtccaggccaggacgggcgcagtggctcatgcctgtaatcccagcactttgggagaccaaggtgggtggatcacaaagtcaagagatcgagaccatcctggccaacatggtgaaatcccgtctctactaaaaatacaaaacttagctgggcctgggggcgcgcgcctgtagtcccagctactcaggaggctgaggcaggagaatcacttgaatccaggaggcagaggttgcaagtgagccaagattgtgccactgcactccagcccaggtgagagagcaagaatccgtctcaaaaaaaaaaaaaaaaaagaaaaaagaaaaaagtccaggccagactccatctcaggctcactggttccaatgtgttccatccatacctcagtggctcttgatttagggaaaaaagcacatcctgctatttaatttgcaaaaattaaataactacttgatgtgtcttttgtgcagataatacccacaaaatattagtttttgccctttttcccttataattttaacatacttattttctttacttgtctcatgttttctttcagagattctaactctctttgctaaatggatataggaataaatactcttaaaatacattttttattgtattgatgtggaaaatgtagaaaagcacaaagggatttttttaaaactctgcaatatcatccaccagtcataatcattattaagatgttttcacagatattcccagcttttattctataaataagactctcatgattcacttatccctcacttgtctaactattttatactttttgacgcactaagattctaaaatgaaccataaaagctggcacatatttatagtaatcagttttcttatttaagaggatgagatagatgagtgtaaataatcttgctatacacaaaattgtttctgctactctgaagacaaggtgttcttacatctcggtctttgagcatatatgtaataaagttttgtgtaaggttgcagactttgtctttaatacaaaggaaaacaacaggtatagccttcatataaattatctcatttaatccataccgtgattttatgagattggtactgttaccttcatgttactgatgagggacctgagccaggagaggcaaaatatctcagtcaaagtagcccagctgctaaaagattctgcctttgaaaaatcgcctgccattgacacctttgtcaccgtcacctccatctctgtctgagccaccatgatcttttttgacctattgcaaaatctatttaacggctacctctaccttggcccctgtatagtgaccaaagtgagcctttcaaaaacataaagcagatcatgtcattcctctgcttaaacctttcactggcatatccctcagggtaaaatccagagcattagtagggcttctaaggttctatttaatctattccccactccctcactttcccagtcactctggtctcacctctccctcttgcttcctgaactcagtgctgccattctccacacagcttgacatgttcctacctcagggcctttacacctgctctgtctcctttgccagaaatctatcactttattcccatctctgattaaatgtcactgctccttcaaacccttgcctggctacgctatataaaatagcccctttcccagctttctttatcaattaccccgattcattgtttttcccgtggtatttgttaccacctggcttttatttgtttatttcttcatttgtttattttctgtcttctcctgcaagaatgttactgtatgagagtggggactttgttttatttgttgtatttccaggcccaaaacagatcctgggcccactaaggaaaatttgttaatgaatgacggaaaggaaggagccagatttccagttcacatcttcaccctaagtccaggctatttcctctatgcattctgaataccagagccacttgaaggaaggaacatacagtgaaacaccggtgatattgtaaaccttccttgcaaccctcttcgcttgccttgctgagattaggaagattggaatgagtcaaagccagagtccttcctcggaagatcactctagcatttgctcttctccactgtcaggaaagaagagaaagcatagagaaaatggtacctataacagtgaattcacaagaaagaggacatgagaccatttgattgtacataagtaacctggactttggatcagaggaccctggctctgctgtgtgacttggaaaaactttttaaaaacctttctgaggttgtttttatcatttttaaaatgaaattaatgatccttcctttggtcatgagagtcaggttctccaaaaagccaaaggaactgtttcctcacgaagtgtcagagagatttttgaaagagctagatactgtatctctgggattaaagtgacaaagcatggcctttaagagatcagaagtaaaagatattttagcacagtggattgtcagtctgcattagcaggtggtggaagagctttcggcagacatgcccctataacttcagttagtggcagcaccattggcacaggtacacccccaggcagctggccctggtaacaaggtggcagcaaggggaattcacatttagaggcaatgaaggcagctgtcgccaccatcataaacttctcctcctcctccttactcttcctcataattctcctttctccctcttctcccctcctcctctcccttcttcatcctcctcatccttcttcatctagctgtgatattttttgtcctggatttaggttgtactggtgaggatagagacagcaaatcaataataatattttaaataaatttttaagcacatatacaacaaacgctgcatttgatacctacactgtctcatttcatcattatttaatctcccttaaggtaggtatagtaactctgcaatggagttgagagaaatgaggcataggagggagaatgacttgcttaaggtctcacaattcataagtgatggcaggaggatttgaacttcttggaggttcagatttgaacctggagtctctttgactccaggacacttgttctaaagtcactcagattcaaaaggtagaatcagatggcttagtgattggatgtgtcagggacaggggactgtgaggaggagaaggggtctaaaatacttcctagttttctgatttgggtggcctgttgaaatgttaatggtgctttacccagggtagggacactctgactcctagaaatagttccagcctctaattagtgtcgagatcattttttaggttaaaaatgagctttgggctagagttacaggaattcttatttcaatctttcacttggttttgcctgtaatagactggctaaactgtaagaggcctcctattaattttaaactgtcttgaactcaaaatagtcaaagtattaagctaatgaaagagcagtgttcttgttgttgagtaatccacttatttattctatagcttcctctcccatgctctttgttccctttgatcataattttaatgggttttggaaaaaatagaaacccatgcactacattggctatatttaacaggagtacctataaaatatcattttgtctaatgtactgtaaataattttttccagatgcttgaatgtttttggagtgtatacctttataaattatacatttttatataacacctgtatctgtttttcctttaattgcttctcaatcttgtgtcacgtttagaaaagcctcctcattttaagatatacaaatattcactctcattgtcttttagaaagcgatagatttatttcataaatgaattatctgataaatttttaaatggtgtaatttttttctaccattgattagaaatgctatgtatattaaaataaattcatatagataagtacatatatttatatataagatatacatatgcatatgactcatatatatgagtcagtgtctccctcagtagaatgtttgatttaacaccccagaacatattttaataccttgttttaatatcttttctcatactcctatagtttttctttctttcaacttttatcctttttatatacacagtaaaacaaaaaatttatttttgttttatatgagaccatatagaatttatatatgaatttagaattaccatatctaaaacattgagcctttctacccaagaacatgctatgcaattgaaagcatttaataatctttcataaatcattcattataattttaagattttcttttgttatgcatttataacagtttattccttggtgttttatcttttgggttactattgtaaataaaatattagtcttcattttattttctaaacgacatttatttcttattggaaatctatacatttcttacaaagatttgtcagtagaccacaaaataaaattattttatttctaataagttttttaaatcaattcttttattttactatattcataatcatatctataaaccacaataattgtgtttcttcctatccaatttatacttcctcattttttgacttgtttatatacttaaatactttcaggagcctaaattaatagcaggcattattgattgtaatgcaaaatgctttattacgtcaacataaagctaaataaaaactactttttatctggtttaacactttctatcctaaattccaccttgatatatcaagtctgtagttccagccttgttctcaattaagatctctccagtaagtttttcggttgtgtgtttttgatccttctaagtcaaagtgttataatgaacctcttaacctagaattgctcttactttgatttttgaggtaatttaatagatgttaataaccaatatgtcttttatgtgtttataatatttttgttttctattttgaaatgtgaattgtgttttatttatttattttgtggtttgtgatgttatttatttcttataattttgaaatatttgtctgcttttgatcctctattatacttttaaaggtgtataatctacttagctttgtacttcctgaaatggatacactaaaatcaatgagaccaatattttctattaatagtgcatttttggtttttgtagcacacactttacttcatacaatggaattcataatgtatcctacctacacacctaatattaaaaattaaccaagataattccctaactctaatataaaaagtataagagaccactaatttacaagaccactatttctatacaaaaaatactaaggaatgactgaactagaagatacattgaagtggttagctctttgcactcatacacagaattaccatgggtttggtagccataaataaagactgataatagtcatttcctattagacactcaagtaggatgatgtatttttttcaatatagttaaaaaattctaagaaatttctgaatgaaaaatatttattgacttaacataaaaaatttattcctgatatagtcaatgattattaaaattgtgtaaaaatatttcatgccaatatgtgacatgaaattcagatctaggcttagatattcatatataggttttatacacacattaacatatgctgtgacttttagaaattgtgcaatctgtgaaaaacgtttgctttgcctgaactgttctgtgcattgaaagatttataacattcatcattcactacccatatcctaaaattaaactgttccagtcaattattctgaatattgacaatgactctagaagttcccaagatgcctctagaagacaaaatactctccctgaaaattactgagctgaaataaatttctccaatttacaaaagcactcatcacttttcacccaaccatgtactagtacgtctagcattttgtcataataattaataaattcaaataaattgtaatatatatgtgtacattgatattgagtactaagagaaatggctatcagattgaaagcttttcagtgagtacatcaattttgctaaaatatcaattttgatgaaaattatagtaacctataaatgttactgatatcttgaaaatatgtaaatctaaagaaattttctttgagaaatcaaattggactaaaataatttatgaatgtattgctaactgtattaaatatataaattttaaaatataaatgggaaacaagtgaataatatgatagaaagtaaaaagcagaagcctactaggtaaaattctataagttaaaaatatgatctgatgtgaaaatattataattattagttttttatcatttatgtttttaatgaaaaaaattctaggaatagaaaaactaaaattattcctttacacattatcctgaatcctaaagttatgacccaaataccatataaactgtggatgctcaattactgttgcattaatatggtcaacaaatgcattttaaacttgagcaagctatgcttaagacaaaggtcaccttttaaagattctgcataaaaggctgcatgaaactccaagtcttagaaaataatttgaaaagcaatgctaaaaggttatacctataaaaacgatttaaatataaatttaaataaaaatctggcttaggtagtataaaactatataacatgcacaagtcattttattgtttgagatatgaaattgaagtatgaaaagtcataaaacctgaagctataatacggtcaaactttaattttaaatatataacgtatgtatttgggaaaaatatatgagagataattgtgtatagatgagttaaatttcaacccatatgaaacttgaaactttattattcaaaaatgcttcatttaatgaagtttgttataataattttggtatgtgtatgggtaatacaatgatatgtactctagaattgcttaaatgaatgatttctatatcattttactataaggatttaagaaccaagattatttggttttctagagcataataaagagagaaaatatatcagtgtatgtaagtgccttagacaaaaagatttagacacttgatctagtggtttcaagactggccccaacccaaaaatacattcaatatgacactttcatatgcagttcgatatcttttttgctttaaaggtaaaaatatacccacataaaacttttacttgaaggcagaaaagtttgcatagtatagccaaaataaataaataaacctaaaaccaactattcaacttgttaataaaatcacggacatcacggcagaaattacaatagtcttagaataaataattattagacttttgggatcagaaataatttaagaaaatcctggtcaaattatactatacttttgtgccatattcacataaagctctatttttacaagcctcctgactctacagaaatagtttttgaaacttcacctgattttcttatggacttttagattctacactttgaaacagaactcttacttataactgaaaattatgttttggatatatttaacattacacagaaaatgtgaatctcctaaaatagcctgtaaaggaaacaggttaaatttaaaacttccagaaagaaagccagaagacacactgctataatcaagcaacttgtatgttcagaaagtgaaaaaaataattactttagtactttaaaaatgtgttcactttctaaatgaaacagaagaaccatgagatgtgttctgaagagtgtataatcttacctatgtatagtacattacctggggacaggtatcatgtctcattgtcataacattttgaaaaatatcttccagttagaggagattcaataaataataaatgtatgaatgaatatatttcattctgttatgatatttctggtagcaagtagggattggtgacttagacataaatttgaggcttcaaaaacaggtgggagtcatgaacacttcacagtctgggcatggtattaagaaattaacatcccagacttagcaaatctttcctggtcttaagtaacaatatggctggtatgatttagtctttggctcattaaacattttataaacccccagaaaaattttttgaagatttcagggcaaaaaaatgtggtaatatgcagacctgtttgcaatacatcatttatataatgaattttaatctgcacccatttaaaatacactttaaaagaaaatgtttatacgctattcattaactttgtgtccgttaacatcatcaacattattagtgtctatcattataatactatcattattttgccttataaattgagtttaattgaaaaatttctccatcccgaaatcacaaagatatttttctacatttctttcatttatatcgtcattttaccttaaacttttagatccctatacacatttagagtctacttctatataaggtataaggttgtaatccagtttcatttaaggtcttattatgagccatttcctcaataccatttactaaagaaccctgtatgttcaaatgagattatagccaaatttctcatatattgagttcccgtatatactcgggttgttgtcagagctctctgttgacccattattattttttttcctttaaaggcacccatatgtgttatgtagtctgtcatgtcatatggttcatcagatcccaccccattagtcttccttttcaaagatgacttcataatttagaaaatattattcataaatatatataacatgataattagtttctaaaataacttgcaatatttttactattgcattaaatgtgtgaattaatttgggaagaattaatattttagctaatttaaggcctaatatttaactccatgcattatatttccatttattcagtgtatatataattttctctttttcattgagcttagtggtatatagagggtctttttaatggagaattagagcatcttttttttaattctaaacattttgcatatcttttgacattataacaggtggtatcacacatataatttctagatattgcaactgatatagagaaacttaattttatataaaatacttgtatctgcaacatttgttgggctccattgttagtattaattatgagacaatatcaagaactcattaaagtgttgataaattacaaaaattttgtaatttatccaagattctctggatatcaaaaaataatggcaaacaaaagagaatcacaaaatcagaaaaaaggaaataacatcacaaaacgaaggataattttcttagtaaataaaaaagcttctgaaaatcattgtttcattaaacaagtatttgttgagcactattctatgtgtcttttgtggcttactacttttccttatcaaaatgttttcaatgtttattcgtattgaagcacatatcagtaattcatctttgtctattgctgaataacatttcattgtatggatataacaaattttatatatccattcatcagttgatggtcatttgggttgtttcaactttttgactctttcgaacaaaactgtaaacattcacatataaatttttgtaaagaacatatattttcaattttttgagtatatactagaagtagaattgctgggtgtaaagtgttatctcattgttttgatttaaaattccagtctttcagcctttcaccgtaaagtataatgttagttatgtttcttcattcttcttatttttttttaacttctcttatcagattgtggaagttcccttttattctttatttgttgagtgtttgtttcataaagtgttgtgagattctgtaatacaatttttttctccatctacattatcatgcattttcttctttatttattctattgatacattaaattacattaattgattttaagccactaaatcaaacttatattcttacgataaatcccacctggtcatgctgtataaacctttctatatgttgctgaatttggtgtggtatcaccgtgttgaggattcttctgtgaattaatttgggaagaattaatattttagctaacttaaggcctaatatttaagtctatgcattatatttccatttattcagagtatatacaattttctcattttcattgatcttagtggtatacagagggtttatagtgctatatagagggattgaaaacatagatttgcctatagttttcttgtgatttgtctggttgtgctattgttgtaatattggcctcataaaatgagttgggaaatgttctcttctcttctatttttggaggaggtggtgaataactactcttaattttgctttaaatatctgttacaatgtctcagtgaagtcatctagccatgaacatttcatagtgttaatttttgttagtttgtttaattactgattcaatctttttacttgttataggttagatttcctacttcttcttgaatcaatttcagtagttggtatttttctattttatcgaagttaactaatttttttaatttacagttgttcatagcatttctttataattatttttctttctgtaatttcagtaatattttatatcttattcctgattttagtatatttgttaatgtttaaaacaaatgaaattttgttttttgatattctttattgtttatctatattttattttattaattttactctacattttatgatttccttctttctacttattttatttaggtttagtttcctctcttatccattgtgttgtggaagtttaggctattgaggtatttacagctataaattttattcgcagcactgcatcacccacatcccatgagttttggtatccattttcaataatctcaaagtcttttctaatttctcttgcaatttcactttgattcattgtttaataaagattgtattatttaacttccatgtaattgtaaatttatcaagttacttattgattttgatgtttaatctcattcaattttggtcagataatgtcctttttattatttcaattttttgaaatatattacagcttgctttatagcatagcgtaggatatgatctatcttggagagtgtgccatgtacatttaagaaggttattctgctgttgttgggtaatgtgttttatagctatctactatttctagatgatttatagtgttgtttgaatctcctatatcttagttgatttatagccaagtgttatatctgctattgaaagtagaatattagagcctctaattgttattgttgaattggctatttctcccttaaattattttttagcttcattattttgaggctctgttgttagttgtgtatatacatatatatatacacacacatatatgtttgtaatcactaccttttctgatagtttgattcttttataattataaaatatctttctttttctctactaactgtttcattttttctcttaaaatctattttttccctgatgttagtataggcactccagttttcttcttgatgcagtttgaatgatatttttttattgctttactttcagcttatttgtatctttgaatctaaagtgtcttccgtaaaccatatatatatatatacacacacgtatacataaagtgtatcttctatagatcatatatagttgactaaatcagaaaacagccagtctaaacgtctctaaattttgactgaatttctgaaatcactttatttaaatatttttgatatatttgaatttatgcctgccattttactttttgttttccacatgtcttatatctcttttgtacctgtatttttttcattgtaattattctaatactagtttcttttatactaagtaaatctctagggcaatattttattttattgtatttattttctcatgatagggtctcactctgttgcccaggctggagtgcagtggcacaatcatagctcattgaagcttctaactcctgggctcaagtgatacttcttcctcagcctcccaagtagctagggctaggagtacaggtgtgcacaaccacacctggctgatttttttaagttttttgtagagacaaattatcactatgttgcccaggctggtctcaaactcttggcctcaagctattctcttgccctggcctcccaaaacactgagattacaggcttaagtcactgtgccagaccctgagggcaacattttaattttgttaatgctaattttactaaagcatatgagtttttgtttgttttgttgttgttttttgtagttgctttggagctaatcgtacacatcttaacttagcagaatttaccacagatttatgctaacttaattctacaatgacatagagaagttatttctatacagatatattccttcttccctccttttattgtgctagaattgttatacataacatgtattatgtaacataatatataataactatatatgtatatgtaagtgtttgttatggaaattccaatcattttaatcaacaaaaacattgttaccatgaaacagttcgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttgagagggcaaaattcagtctgtagaaccttgtctccagggagataatttgcattgccaggagacaaaaaagggaaggagacgtttctcactctactcttttgtaatttccatcttttaaatgtgaatgtgaaatttactcagaaaggtaagttacataaaatttaaataatagggttattgtatctacatggtcatgtaaatattaagtatctccattaccatggcattttactaaataatatatcagaatataattaattcaataattttgttttacagacctaagacacatgcatcagtactttgttaggttttgaaaaatgtcacagaaaaatatctgtatcctcaggaaggaacagcccattaaaatattattcaaaatcaacaagtatattccaagattaattcagcaaaagtggagtgtatttagtaaaattgcaaatgttctatttggagaaaagattgctttgaaataaaagttaattcaactcagagagaaaacaactataaatattaaggatacgatcaataaagttactaaaaatatggctgtgcttattcaagatttagaatccaaacagaactcattgggtctagtaactactagcctgaaattaggaagatttgtagacaacaaattacaaaagtaattgagagactaagaagatttaggacaataaatgtaagaattctcttttaattgaaaacctaattttgtagaatgcttaaaatataactaatcagtcatagataaaatagcatttgtaagtactctacacattgcattctttgaagcaattattaatgattaatactttactctgtgctgttatttgaatgtcatagatctgtataaaaattaaaatgaaatgagacagagtccattcaaaatggcataatgcataattggatacaattttaaccttgattccattgttctatataaagctactatttcaatttaatatagctaatgttctaaccagaaatttataatgttaaatacttcatcctaaaacttcaagtgtcatgtctcccccagacagggatattaaaggccattttttatctcaaggtaagcctgaaatatagataatatattaatattccagtatttcaaattgtaagcattaaaatgtcatctaatgaattttgtggttaaatataatttgacatattttaatctattcaattgcaatgagtaattttggcactttgtttcaacttttaaaaaagtgaatttctcataatggatctcttaaggaattatctattaacataattagaaattaatacatgttattaatggcttaatcaaagaaactgtaaattgatgtgggacttctttgcaactttgctgtgggtctaatcagtaatatttcatgtactcgtcttcacccaccccatcctttattaaatatagaggggaaaaaagtggctcatgtagactaggactggttcaagaattttacaaatatatgatttataaagtgatatggaggagagacatgaaagaaaaactgacttattgtacagcaaacgttttaaaagccacttaacaaaaattaatgctatatttgctctatttctatacaatcagaaactattaataaatatatatctttcatctataatggccagaattattcttagtaggcctcaggaatggtcaaagtaaaatttttgccagggaaacacaataattgccaatgttcaatacttggtgtgccagtcaatgagggaaacaaaaatgttgctttacaacaatccctcctaatgtttaatgttactgttaattgctttatgtaaactctatgatcttagttccttagtgatgctcttattaaccaaaatccttgtaatacttaaataagtacctatattcacctaaccaaaaatgtgtatatacatcatgcttttattagtcccattagtaaataatgaaaatcatttataaaaatgacaaataaatatctgtaaaaataaaaaaattagtagcaaggtaaatccattatatctctattatgtatacatccaagtctttagtgcactgtgattcctattggtgatttttttcaaaatgattttaaaatctaaaagcttggctgggcatggtggctcacacctgtcatcccagcactttgggaggctgaggccagcagatcatgaggtgaggagtttgagaccagcctggatagcatggtgaaaacctgtttctactaaaaatatatatatatataaattagccaagtatggtggtgcacacctgtaatcccagctactcgggaggctgaggcaggacaatcgcttgaacccaggaggcggaggttgcaatgaactgagatggcgccactgcactccagcctggtcgacagagtgagactccatctcaacaaataaataaataaataaataaataaataaataaaagctttctgagaacatttgatcttttaccagtgttttgttggaaaagcaggtgtgaagttatttcatttatagggaatactttatattacttcatgaatttctggagttatgtattaagacatcacccacagtcaggaccaggaaacttaataaatagaaattcagttttaagattgtctaacgaatttataaatttccccttagtcctgtttatagaggcttaggcagactagttttcaaagaacaaaggctagctctcatgtcaactgtattcatttctgcatgtcattctgaaccaaagaaatggatgaaactcatctgtacttttgactgagggaattacatgatattttgctatcattggaaaacaaataaaatgatctttctttactttcaacaaacccatacactcccccatcactatccacacaccatcatgattctacagaaataaataaactcatttagcctatcccaacagagggatttcacaaatttagaataccataaccaagtagtttggaatactcctgtacaaacatgacagattacatgtgtaataagtgacaaagaaatacacctaagaaatgttataattatccctattttatggacattttttgttttgttttttgaaagatgtaaccacattaaaatgtttatgcctagtatcttacttgcaaactctaggaatgactttataacaatagtagctaacactcatgttactaatatactgatagtggtatactactatttcatttcatcacagtaatggcaagcggattgtaatattgatccctataatgcaattttaaaagttatttttaaatttaatttaagttacataagtgacaaaaaaagaaatttgaattccatgtctataactcaaaggtactgttctaattgttagataatactgctgtaaaatctttttaattcccttctgctctggaataaaatctaggttataatactccagattttaaatgagggctcaagtatacttattttaatattgttttctcttaaactaatttgccgtaagaagaattttatagagaatattaaatataaaaatgcagaggatagtttaatggtatatttatgtcacattttcagtaagacaattactatgcttttcgttaagtaagaattactttatataagtggtagaagttttcttgtagtgttttatacaccttaaggatgccaaaagtaaaacaaaatggcaagtccgagccggtattccactacaaataatattttaattctatgactctcatttcatttggatagctttgaactccatctggtcactgacaggagggaaaaaaagtttgagtttccattttcattaatatcttcactttttaaagtggaaaatggaaagcttcaactgctaacaaatcagcaactaatacattcataaatgaacctgctcctataatggtctaaagtggctctctgtttaagaaagcaattgatgcaattggaccttcctattattttctttaaataatgaagttatttgtttttaaaatacaagtgcatttatattcacagtttacatgagtggacaatattatatttggttttatgttttacacaaaatagggatattgacagaatgttaatatgttcatattaacatactacctaacatatcttatgaacatattacttaatgtatcttatgacctaacatatcttatgaacatattacttaaaataaaaaaaaaaaatttcagactacagaaaattaaagcagaaacttttgttgactggatgaattctaagggtgaataggaaatatatttcagccagctatgacaaatagagaaaaacacaactgaaaaagaaccccagccatctatctttgatactatgtctctagttagctacattaatttaataactcatggactatttctgcatcatagtcttattacctggaaaataggtaggttgtattagatcaacagttctttgctggatgattttgcatccccatgggacatttggcaacagttgaagacattgtttatatcacaacagtgggaagggcgttagggctggcaatactggcatctactaggtaaaatggaacaggagaactccacacaacagaaaattatccaatccaaaagagtaatgtcaacattaggagaccctagaacaggcggtatttatggtttctatatctgggatttcaggatgagttttttagagttaattggggaacatgaggtagagtaaggggctgagatgcctttttaccaattaggtttttttcaaacaaaaatttgaagaattagtaacttttagttccaactgaattatccagaatgttctataaaataccttcaaacgaatcatttttctttgaaaatactacgctaaggctaatctttcacttttcaatgtggaggtccccatccaaagtttatggcatttatttatccagtcttacaataacatcttacgttgctatataattataatatgaatattatggatgatatacatatctttataatccatttaaatcacttctaaagcatgaataatatatatgtcttttacacatgcatgtatacacacaaatacaatttacttataaacctattaagaagttagcactatgggaatattatatatattatatatatatataacatttttcatctctctgtctccaaactttgtgattttataatttcaataaaagtacaattttgttcaaactgtatttgtatcttatgtttctgttcatgcttctgcaggatattttacaagataaaagtgtggtccattgttatttgctttactaaagttctaaattttaaatactactaagaccaccaggaaaatactttctaatttattagaaaatacttacaataaagcattaattcgataattcaagaatgccaatataaatacatgaaatggaacacagttaaaaataaatgtatgaacagtcacataaaccatttcatgtcatcattttctgtatttaccaaagttatagctctttcgaatgattattgctaatgtattcatctctgacaaagcacaattatttatttaaatgaatgaacaaaagaaataaacagactggctcattttcatgggtgactgactgaaggaatttaagacttgcttcaataatcctcaattcatgaatctagatggtataaacacatattgataattttaaaactaaaataatcaaaaatgtacattaaaatatttttaaaataaactgaattattattcatgtaaagaatttgaagtgatataaaaatgttaaataaataatacaatgcaattcagtatattatttcaataacagtttttagtgtactctttgaagcagaaatattataacattctttgtcataatgagaagacaattttaaacatcttttccaaatattaaggttgtctggcatatgagactacatttatgtgactgtatgttgtatttcaatgatgaatgagttttacctagaaaagattaatagaagattttaataaaagtaaactatatgagagtcttacagttattgttgtaagagctaaaataaaagcttcacttatagaaaaaaatactaaaaggtttagtaactactcaatatgaatttgcctgttactaaaatattttattattaggttgttgcaaaagtaattgtggcttttaccattacttttaaaggcaaaaagagcaattacttgtgcacctagctattcatagaaggaggaaaatcaatatttaatttaacattccatgttatgtggccactcacttatttggtggtttcaggctccattttggggaattctacagtttctttatggtttcaggaatgtctgcattaggagaggttgggagagagggtatcttgttggatgtaatttcttcattttactttaatcaaaatagtttctcttgtaactatacacatagagaatttcagaagaggcttttaactgaacagaaggatttatagaacaacaacaaaggtagataatttcaaattaatatggtaatatgcactgctcttacactgatctcttggtcaagtaatttaaaacaagaattaaaaactaaaattgaaatttaggtaattaaattctatgaataattttataaccaaaaggggcaactattgagatgctggagattaagggtatcctatcttaaggaatgtagccattgtggaattaggacagcacttttaaatgtagaacatacctgcatttgtttcttgtcaagttcaccattagagacaaaactgattgtcagaactgtggaacatttgagtagcaacatactttttatactgacaattaggttgaaacaaccgaagaatgaaacgcataaagaagtgtgttcatgcccaccacagaataagaattgcacttaaaaagttaaggaaatataattttgataggaaaatatttgttattagagagaataaagaaattttgtaaagtaaaaaataaacccattgacatattgagtagtagtgtgtacattccctgtccaattctattacaagcaagtctaaatctagagccactaaaatttctatgatagacagtttatctttaactagatgtattttttctgttcaactaaaatgccttagtaatttcagtacgattttttttcttagatgtcaaacatcttttaaaattcaagttatggatcacttaactctaaatacatgcttttattttatttccaaagcttagaagacaaagattattaaaatctgagtgttcaaatataaaatatcttgaagtatatgcattaaatgttccatattttaggctaccattgagaagatgtttctctaagcaacatttgataagactaatcatgaaactaaacagccagctgtttagattatagtacaatccttgctgccatgtataacactattatcatcattggttttataatcctttggctcaacttactacttactggagatagccgaagagaactaacaaagcttttaatgtgatggtgttaaaaggtgatatggttcagttgtgtccccacccaaatctcatcttaaattgtagttcccataatccccaggtatcgtgagagggaccccatgggaggtaattgaatcgtgggggccatgtccccagtgctattctcatgatagtgagaaagttctcatgagatctgatggtttttgtaaggggcttcccccttcccttagctctctccttcctgccgccatgtgaagaaagaggtgattgcttccccttctgccgtgactgcaaatttcctggggcctcttcagccctgcagatctgtgagtcaattaaactgccttcctttataaatactcagtctcaggtatgtcttcattggcagtgtgagaatggacttacacgaaaggcgaacataaatccctttctattgggacaacagtatttggagttaagagttaaaaagaaaacataaaaggatgaactgtaaaccttcattcaaaaataaaacagcatattatattacactttcatatgcaataatatttttaaaagttcaatgtaagtataaatttgtgtgagatataaccaacttattatagttgtagtttcataaattaaaagatgtggatgaagttccaagatttgaaattactacgcttttattatcaaagttaaagatggcagagtaataataattatcttaagtttgaacaataaatcattcagagggtggtgcccagctggttgtttacttttccccttagagaagattgaggaaatagtattaagatttactattagaaagatgtttagaagaataattttgtgacagtgattaaattctaaaatccttgatccaaaagggaattgagagtatgaaattagataatgaaatttcctgctgtgtatcacatgccatcactgaataaattctcttgccacatatttttgtattgtgtttcttttcctctgtgtcataaacctctatccacctcatttaacatttttactgatttttttctcccataaatcatattcttattgtgccaaatactattaatataaaatctaacaggctaacataaagaaagagatgtcactttatccttagaggtatctccagatgtgggcctgtcatgtggcggggggagtatctgctgagcctcttaagactgtggagatggcagaagcagttttatgcctctgaggtctcagcaaattggcatcagtcacacttacctgtctgtttccttcactgatctcttttaaactatttctaaaccttccccctgtccatatcgtgcctctgtattcgaaatataatattattagacacagaattttacttaaaaatacctactcacaggaaaataatgagactttctcaaagaaagatcattcctatatttttggcaaagggatgggctcctctgggaagcctttcagagagctacattgacacatttgtataaaaataaatgaaacagtattcatcataactacgtgtctcttgcaggattctataactcctaaactaacattctgcagatggcatgccaatgtgttcaagagggatcatatataatttggatagttttgatatattaataggatatatacatcaggctttctttttaaaaagtgaaatatatatgatcttagaggcaaatcaatgacttttatatttttgaaacccctaaattaactttttaagccaaatgaggctattatataatagtcatcattctttaaaagtttctacttccatttcttcccctcctgataagtttattttctcctgtatcacaccactcaaatttctagtaacctcttaacttccaaaaggaataatggtgtgttcctcatgccctgtgacttcctaccaggatttgcttacagtcactatccctgaatggaaactatttttctctgatcccaagatcctaagcagagcattgtgtgtatgttgtactctacttccaaccaaccctttaaagcaccaggcactctgcatgttgcattctggccagagtgcactgctttgaattcctctcatttgactctttgacgatccttactcagtgctcttcttcagcctgtttcgtcagtctgcaattatctttttcttctttacctccagttgaaattttacttctatttcaatatctattttaaatactttctccttctaatgattaccctcacacccacttaagtacacacacttgtacacacactcactacctctctaggtagaaatggttgattcttatcttgaattctgcttgtactctcacgtagcaaattttttcaaacagccaatatataaacttcaattggacttatcgctgtattgaaggcccagattattattttttagaaattggctacattctagaatgcctagaaaaccaaactagattgtatacttaaaaaaattaaattaaatcttaaaagtacatattaatatttctaataattcagctaagaaaaaacactttctctgaatgtagcattttaccattttcctgacatttctattttctaatgtattagaaataaatgttaaaggttttggggggtgataatggcctatgttttaacttcggcttaatgtttattaatgtgttacttctgaaatcaattatttctataattgttaaatatgtctttataatgtctacaattgttaaatatatctttataatttaaaaaatcatatgctgaaagcaaaaccattggcaaaatgaacgcgttggacatttttaaagcatataagaaagaaagaaaggattacagcacaatactagagaccttagtgcttaataaaattctatgtgttttcccacaattccactttaatattaagtgtaattgtaaaatgattctgaagatgtagcaagatgagtgtcaattataggcaaaagccaggaaagggtagcatggaaccttctagttctttcttccactaccacagtacccaatgaagcaatgtgcaacagatggtagaggctccatcaacctgaagcagaatatcctgctgcctacaatacacatagacatatcaacacaaaactttttctttttaaatttttaactgacacgtaatatttatacatatttatgggatacagtgtgatgtttcaatacatgtataaaatatgtaattattagggtaactagcatatctataacctcaaatatttatcatttctttgtggtgagaacattccaaattctcttttctacctatttaaaaatatacactatattattgttaactatagtcacttgactgtacaacagaacactaaacattattcttgctatctcactgtaactttgtacccactggacaacttcttattcccccactcccaaatccctctaggcctctgctagcaactattctactctttacttctagaagatcaacttttgaagattccgtttatgagatcacgtggtatttgtctttctatgcctggcttgtttcacttaacatattgtcctccaggcaatttcgtgttgcctcaaaaaacagaattttaatgttttttttttatggctgcataatattacattgggtaaatataccactttttttttttatccattcttcagttgatggacacttagattccataacttggctattgtgaatagtgctacaataaacataagagttcagatatttcttcatcatatttatttcatttcctgtgaatatatacccagtgctgggattgctatatcatactaaagttcaatttttaattatttgagggatctccatacttttttccaaaatggctgcactaatttacattcccaccaacagtgtgtgaaggttcccctttctcaccacatggcctctccaacatttgttattttttgtcttttgataatagccattgaaggtgaggtgagatggtattttacagtggtttgtttgcttgttttgagacagggtctcactctgtcacccaggctggaatacagtggtgccatcacagcttattgcagccctgactccatctcaatcaatcctcccccctcagcctcccaagtagctacttactatatacttaatctgtgtgtgtgtgtgtatgtgtatatatatgtgtgtgcctgtgtgtgtttctcataatgcctttccataatgtaaggaacatattgggaaggtccttggaattacagtaaacacaatacatttaaaagaaaacaacccatttcatagttctagatattatcttttctctttctctttctagttcttggtttattttcttgcctttttagactaaatctctgactcactttttgaagctcctaataatgcaaaaatttcttctgaatttactaatttaacctcttttgttatattcacccacacattatatgcatgtcaccattctctctgtctggaataatctttcccctgatttttgcctggttatgtactactgattcttcagctatcacttgacatgcctttgcgttggaaaacctctgggtcctggacttatatactctctcataatttgcattcttaactctttttattcttaacaaaattgaaaattaaattattttttatatttaataaggcatttctgtatccaccattaagccatatgctacctaaagacaagcaccatgtgtcattatctctgacatatcttgtcacaggcaagcacagtgctatgatgagaacataatagatacacaaaagcatgtgatggataactgcagtaacttataatcaactattttgaaaatggtatttctaggctaatcatacttagcatcattgtatcaatttgtatgttcatcttaatattcactaattttgatcattttttcaaaacacatttctattctatagctttcacttttcatagttaatttaaagttttctaaaaaatgaacattttcataactttaaaaaaagcctttatcaattattctaacagcattcagagtaaaaggcaacttaatttgattgattaattttggatttagttaagttagaagttgccaaattataatatagtatataactgaattttatatatgttagatatttacaaattatgcattgaattcaagttttaatatttaacatctggtaacttttatgaaacagatattttattactatatttcaaagtttcctgttttattgcattttatttacttgaaataaataaacaactgaaatacaggatgaagataacaacaaaactcacagctaacatttatcatgagcaggtataggataagtgattgacatatgctatcttatgtaaccctcacaaccacccagaggggtaaacgccactattctcatttagacatgaggaaactatagtcataactaggtatccagttctaaaaaaggagcttaactcaaatgcttgaggccctgccatgatgcaccactacttcattgcattaaacacagtttaaaattaaactacacatatccttaaaatttatctgtgggagcaggagaaataaaactaagaagaatggttggttttattaaaatccctttcctaatgtcattgagcagtacaacatgtttataattaaaatgaatgaaacttaacattggctttattcttttgtgattcctgcacgtagcatccttctctaccacatagcacaacattatggacaacagcatgagaaccatctttaattctgcctcctgtttccagtaactccagcaataggagtcaatgttgaagataatatgtaaataaatcactaataattcagcattacccctaggtgggctagggaagagcataaattatttcaatgtacagtccagtaaatcctttgtttttggtctctgatgcgtaaccattaaagatgcaccttattaagaaattcttatgtaacatttctagacataaatgtcatctgtctttccaaaactgtcttttaaaacaaactcctattcagctatctttacatagttgagtagtataggacatttgttaaacataaatggaaaaaaccatattcttcagaaacaaaatattattcatattagaagatcaaatggagactttttgcttctctataatattttattacttctctgtttttcttctgatacttcgggcgaaactggtgcaagctaagagttgaaaatcaatgccttagggcatgggcttttaataccactacatattagaatcaccttgaaatagtaaatacatgaaagctgacagcccacctcagaacatttaagttataattggatggggccagaatgtttagagtttgaaaagtttcaaggtgtctctcatatgcatacactattgaaaactactcttaagaggtaagaaacctaaacaaataaagtctattcttaaaattcaatttttctacttactctcccatagcaaattcatgtatttcccacgatattatttttttattctccccatataccttacaaagaggtcattagtactctaattatattttgtccttctctttaggaagtgtttctgtcaggtattatgattattttactttataattataatgcaataatattttgcattaaaaattaattaacacatagaatgtaccaggtattgttccaaaaaacttttccaatactgagtctacagcactattgctatcttcatttcacaaacaaggaacttggagcatagagaaggtcaaataacttgactaaaaatcagtcagctgttaggtagcatagacatgatacaaccccagagcagcatggtgcttcactaataataacaaaataatgagttgatagttatatagcaattagaacagctctggcaagtgttaggttattgcttactttactattatcattatgatcattattattattatttactgtgtgattaccatgtgctaggcataatgctaagaactttacatagttacatggttgtatatgctttatttcattttcacctcacaatatccctgtgagatgagaacacttattgctgtaagcaacttgtttcagtcacccaaccaataagcagatgagcctgaacaaaaacccatagttaaaaccatggcgtttttctttttcattttgtatcctgtacaggatttaataatagttttctcaaacagtagtaaactattatttactgaattgaattaaattgaatttgtatatctatgattcaaacttagttacattactttgcagtagagacattttcctttttttatatatatttgtgtctgtcttatttaatatctcttagcctgacgttcttaaaaaatatcagtttatcagatgagtagattgcaaaaattttctcccattctgtaggttgcctgttcattctgatggtagtttcttttgctgtgcagaagctctttggtttaattagattccctttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaatcctttccccatttcttgttttggtcaggtttgccaaagatcaggtggttgtagatgtgtggtattatttctgagggctctgttctgttccattggtctgtatctctgttttggtaccagtaccatgctgttttggttagtgtagccttgtagtatagtttgataaactggattaagaaaatgtggcacatatacaccatggaatactattcagccataaaaaaacgatgagttcatgtcctttgtagggacatggatgaagctggaaaccatcattctcagcaaactatcgcaagaacaaaaaaccaaacaccacatgttctcactcataggtgggaactgaacaatgagaacacatggacacagcaaggggaatatcacacactgggtcctgttgtgtggtaggtggacaggggagggatagcattaggagatatacctaatgtaaatgacaagttaatgggtgcagcacaccaacatggaacatgtatacatatgtaacaaacctgcacgttgtgcacatgtaccctagaacttaaagtataattaaaaaaaaaaaaaatccatcattcacataaccttaagccaatgacctccacaagcttcactttccttatctgtaaattcagataatggtacttacttcacaggaccatttggaatctaaggagttaatgcatgtaaaatacctaggacataaagcgtcaataaaacagctcttttatctcaaaaaaaaaaaaatcagtttagttaaataacggtttatctctttgggaaatgtaagagagaaaacagtctagaattgcgacatcactgtcttttcaccaaatacagaatatgggtgtggtaggcagcttctaaggtgaccgccaatgatctctgactcttggtattcctactgttgagtctggattggatttaaagacttgtttttaatgaatggaaaatatcagaaataatgggatattacttttgagattaagttataaaaagaaagtatcttcagccttgagctctgagtgttgctatttctctcttcaaccccctatctcagtggaaaaacagcctattgcgagcacccctatgaggagagaggtccatctgaagatgaattgatatctctcatcaacagccggtaaaattctgaggcctgcctatagctacatgagtgagtgtgaaagagcgtcttttgaggcctactgtcagtccctttgacaagttttggggtggattatcttccaattcagctttaagatgactgtggctaaataacatcttggataagctgattcacttcggtgtccttagagaccttgagccagaggaacaaaactgaactacattcacaattgtgagataagttttttcttaagacacttcatttggggataaatttttatgcagcaatagataactaataattatattttggttatgtgatatatgtgaattcattttggaatcttcacataaacttcaaacagatagatatgtatgcagctagaaccaaataaaaacaaaggcctacattactgaatattgggaaagatgtgatttttatgtaaatgcaacatatgtgcagataacaaaaatgtgaccaatatgaatcctgaaatgaaagacaggagcaggcactatgaattactggttttcatgtacagtgaggcttctgtcacagaccaattctccacagcatattctaggttaaatgcaggaagaatttttttttttaagtaaaggtgcttgataattctccttattaatgccaaatatgtcagtaggctttccacaaaaaaataaggaatggtacatcattttcttactttttatttataaaactagaaatattcattacaattataaaaattgatttggataacaaagcatttaaaattgatatggatgaaaaagcattgttaatatcttattctaagtatttagtgggatgataagatttttgtttcagtagttctaacagaaccaagtcattaattagggaaatgatagtccttcaaggacatcattagaatgatgagcttctgctttcaacaaagagagaagccagagaaccgaagtaactcaaatttgatacagattcacaaaggatcagaagttcaaaacatactaatgcatatgaacattatattagagaccactgcatcccaaactggtattttacctaataatatataagcagttataatatttttaaaaatgattcctgctcaaataagtttgagaaaaaaatgctggttagacaggcttgttaattgtagggctctcctgtgctttaaattactaatacgcacgattaatctctaagagtgaaccaagaaacagcatttcctaccttcatttgagcattgagatttttgtgaaggctaaacaattagcctcgcccagagtaatgttccatggaacaataaatgaggaacactcttaagtatcataattcaaagagttcacagtaagctacaagaaagcaggaaccacctttagccactcccagtgtactcccagtactaagtacagtactgacagtgcaggcttttactaagaaattactgatgaatgaatggatagacacccccaaactgtaagttggaaagtattagctacatgcatatattattttcaattgtagccttgcatcaaataatgatttatttctcttcatctttctaccagcatctcaatgcaaggtcacttcagaagtctggaggcttctataacagcacacaggatcaaaggaaggaccctccactcaagaataatctgtcatgactgcggctaatatcaacattatccaagaccttatttaggttccttgaaagctggtatctgtgcagcttccattcaggtggaaggtactgaaataatcatagactggcaaaaatggccaagcgcagtggctcacacctgtaatcccaatactttgggaggtcaaggcgggcagatcactcgagctcagtagttcgaaaccagcatgggcaacatgggaaaaccctgtctcaactgaaataaaaaagttaactggacatggtggcatgcacctgtagtctcagctgctcaggaagctgaggtgggaggatcatttgagcctgggaagtcaaggctgcagtgagctgtgatccggccactgcactctaaacctggcaacagaacgaaaccttgtcaaaacaaaaacaaaacaaaacaaaacaaacaaacaaacaaacaaactctatttttaagtcctcactgctaaatgcaaaattttctaccacagggtggtagtaatagatttctgttattgagaagaccctcctccccacccaccccccccccaaaaaaaaaaacaaaaacttttctctcctggtatttagtacttccttcttttttttctcttttatcaggaaaactgatatactattttcaatgagttttggattttctaagggcacacacagagagaataactttaggctacttcttgaagatataattcaatgatttttaaccaatatttatgccatccagcatcacctggagtatagccaatcaaacaaagcatatgaaccaagtaatcacacaatatctgcattgatgtgttgcctacatgcagcagaatgatctggatagctcaccaaaaacataattcatatataccttttttactccatttgccaacatactttatttcagagaaattttaaattatatctcagctgtttctcagagctcctttgtggaaattacatcctggtttctgttccatacttgagtagactacaggctttccagtacattgtccattggaccaaaatctggagcaagagaaatagtgttatggtagtcaggacacagtagctggagccaaactatctcagttcaaattttcgctctgtcacttactaagtctttatccttgaacgtattatttaacctctttgcctcattttccacaactgtaatcaaagggagtagtaatagtatgagttagggtcatcacttaaattgagtgtattaatacatgcatcacttagaacaggtgtgtggtgtatatatctatatctatatttatatatctatatctatacaatcatccctcagtatcctcaggggattgggttcaggactgcccgcatataccaaaatccatgcatactcaagtcccgcagtcagccttgtggaaatcatggacaaaaaatgttggccttccatatatgcggatttagcttcctgcaaatactatgtttctatctgattttggcagatgaatgtgaatgaggaacccacctatagtgatggccaactgtaattattgaaaaaaatctgcatataaatggatctgcctagttcaaaccatgttgttcaacggtaaactgtatatctcttctggactctccatttggaaacacatggacccagaggatttcttcctttgcttgtttatttttatgtgagtttgggcccacatttatctctattggctgatccagaagattcacagaggttatgttcttcatcttgctatcccaaccgtcaggtccaagactttgtattatctttttctcttacttcattgacttgtagatgcccctggtccttgatccatctttgtgaacttaatgattcaaactctgttgtttatagcaggtttaaaagaacagctcttattactagatgttcagaaaaatataaattttatgtttctattaaatttagaagattctacccatttttagcattaaaaaatatgaaatgtttattcagataaaaatttagtccaatgtagatagatatacagtgtcttctaggtaaaaatgtttagtctcccagacacctttccttcttagtttttgtctccttaagatagtgcctattcatagggaaggggttggggggataaatggaacttattttataaggtttcatggtggtaggggaagcaaacaaacaaataccttgagtgctatgtcctcagatttctacggtttccaaagaattggttatgtgctgttggcacagaattggttatgtgctgttgacatctgctagtgatcactgctgattctgtatcgagtgtgagtctctcagcttagaaagcatgtaaaagtgatcatgtgatcaagtgatcttcatcaagtggaaggttcacctcagcttccactgcacctgtcacttatgagctctcactataatttcattttccttcatctggggatagcaggtagtgattcctaaccttttgtgcaaagacctctgacttcatacagttctcccagcagcctcttggtaaattctgagtcctattgtaactctggaacccagggtggttccaaaaggctacaacatagggccttttctccctgacctgttgcattgctaagtaattatagctgagcccctagtgattcaagtaaaccttcaagaagaacctcatcccagactcctggactatgggcaagagttttctcctcattgttattccttcaatatatgtaacatacctcatggataaggatggctcttatattcttatataatcctaaattaaatgtcaactattaagtattatctctgacatcatctttatattccctccatccttattctcaagcaaatgaaagctatacaacaacatagggaggtactcagaaatgcaaatgatgaaagcataatgtcccctcgtgaacacgaaaacaagttcctggtaatttacgtgcattttgtggtaccgccaaatcccaatcaggaaaataagtactgtgtattgaaattgtacctctgatttcaaaattaaaacataaaaatttttagtagttatataattatgttagttgcatgaaatttgtttctaaaatatgactttgacaaagatatatataggacacatagtaatcaaaacaaaagtggcaattttctcggtagtactatctaccctcatgggctattctatggaattcctttccctattgttttaggtaagccgtcagtatatctgttttgcaaagaaaacaatgatactgggattttagtacaactcatgtcacttagtttccatgtctatttctttatatgagttattatttccttttaaaactatcatttatgtatcatgatagattcaaaatatatctaaatacacgttgcttattatgaatactaaagttaagtaatgcagaatttatagattcatactccagtttaaaattaggtagcttacataggggcatttatattgtttcatggaagcaagtttattagtgctttcctttcaagcatagcctaaatacattaagattaaatacattaaggttaatttgagagtagttttaattccataggaacatacattagccatatcttttcatctggaaaaaattataacaatagcaaaacaataagtctaataatgtctacaaagaaaccatatgagattagaaatatgaaaccttgtataaatccctcttatcagtccccatacaattgtctgaatccccatggctacagtcaattatgcttttttttcccccacagagataccagcaccaataagagaacagtttattctgcctcttgcagtgatttttgtgaatatctcaaaatatcgataataagaaatgggtcctgtcaatcaatgcatctgatggatgctaattctatccagaaaacaatattaaccttttccactgtaagcctatcaaatactagagatctaagatggaataatagctcaaaatgaatttctccatgaaataaaaatagaactgcttgttaatttttctcgaaacacagattagtaaaactgcagctgtttcaagaagtgaatttgtgggaaaatgtcaagtgtgagacatttttctttcttgaccaattaaaagtaataacatgccaactttgagaataatagtgtgggaaatagtggcagtttttaaactttgtaaatagaaatatcaaaacatataattagtttcaaatttttggttaattaaacacaaatacctatttatctgttgtattttgctttcatagtgggcttataatgttggtatgaagaaaataaaaatagctttattgttacagcctatgtaacaaagcatgacaaaaacatccagatatctaatttctcattggtctgggtctttcgcagtgtggatgcataattttgttatcaaattgaatggatatttttaaggatataattacatgtttcttggggaagttcaacaatttaaagtatcttgtcaatgttttatattttccattcctccaaaacttaaaattaagtagtgagtcactgattcaacaagatgtacacaaaagtatgtctactagtataaattataaatgtgaaactatagtttagaactctcatcattaaagttattgggttataatagaaacacatgtaatacatgtaaaaatgtataacacaagctcaagttgagttataaaaacatgttttgctcatgaaatttaattttttactaaatttgattagttgaggcttttaaataaacataaacattaatgaattaaataatgtataattccacaaatgttttctccacatgcatcttatgctatggaaaaatatttatccattctttccacaaatatttattgagctttgaaatatgccagacactgttcttggaagcaagaacacatgaataaacaaaaacattctaaatgctggcctttgtggtacttgtgctcatgttttgtatattaaataaaaaagacaaaaactatttttgtgacatttgcagtttgtggttaagcaggcagtaaactcttcttcacacaagtcaacaggggaagcacaggttgtaaatatctgaatgaaagagtgatgtgatacagaataatgtgtgaaggcccattgtagggaagagacagggaagcctttttgaagtgataactccatggcgtgacacacttttaagtttgcctaagacagttttaatttacatttgttgtcctaacagtctgtcagagtagcctttgctccactcaaatatttaggagaatgactaaggtaaagtagtagactgattgtaagcattgaagcaggttcggtaagggatggttttgattgggtttagggtgatagtaactgagattcagaaatgtggatacacttgatacaaatactctaaataatcttcttttccattcctgtatttaagtcccttatctattcaaagaataagtagcattcaagactctaaagttcaaataacagaatgatacaccacttcctgctttagaggctcacagcccatctgaaagagacagacaaataaacacatgcatataacttagagctacaggaatcctagtgtaattggcaatgggtaagtggatcaccaatgaaagagaggtgaattctaactatattcaaaaacaaaaaagattcacagagtaatggaccatggacttgagatttagaagtgaatgatggtcatttgtcaattgggataatatctctgtaaggtgtatgaggtcctaactttggtgaatgaaaactacaatttgccttcataaattgcttacattttttctgaagaaagatagttttataattccatctattaatatttctttgaaccccctgttacctgagaaggcaatctattttgaaatgaaaataatagaagcttaatacattaacctggaaacactttataatacatatcacactgaagaggtcctacataagtactcttctgttcattttaaacttgagctttattatctgttttttgtaaaccccagagctttcttaatgagcattatgaaaaatcttttaaataagacaaaaacattttaggtttctattcctttttttccctcagtgctttcaaagaaatttctgagcataacctgttgtataaattatactagcaggttatgattgtttggggtacttccttgatttttcacatttaaaaataaaactgctcatgttttttttgtttgtttcaaacagcaagtagaaaaattgtcatacagaatgttacctgtaaactttatctttgttcatgttttagatttttttccttgatttgaatgacttcttttttcttttcaggtacttatatgtgaattattttcaaactgtactttttaagcaatagatgcggaaaaaataggaatactgacttattatgtcctcaaagtctcctctcaacaaataccaggagatttccagttttctcttacatagtttggttggaattagctctgttttgattaatactcatgaacaatgtgtttgttctgccctcttttttaaatatgggagggagttgatgttggtaattatttattatttctctcaactttgctataaaacaggaggaatttcattcaacttccgatcacatttgaattagataccagaagactaataataagtaattttacaatgttgatgtgcgggcaattctagggaagactcaaaacccagaatacataaaagggaaaattcacacgattaattacgtttaaaaattcacatggaaacacattaaagagttcaaaagagaaaagggaaaagtaaagccatgaaatacaaactatccacatgagtactaaaataccaaggtgtaggttatacatgtttatatatttgtcaaaatttggaatgtacacttaaggtttgtgcattttattatatgtaaattttacattaaaataaataaatttgaactctagttaatgatagtaataataaggtatttaagcgaaagtacgctgattcctgcaaagtattttaaattgcatccaaaaataaggtagaataatgtatggataggatgaaggaaatatggattgtttgtgccacgagtttaaataaatattagtgttagaatctaggtggtagatcaatgatgttcattgtaaaagacctttaaattcactgccccctttttttttttttttttttgagacagggtcttgctctgtcacataggctggagtgcagtggcacaatcatgactcactgcagcctcaatttcccaggcttaagctagtctcccaccttagtttcctgaatagttgggactaaacatatggccgaccatgcccagctatttttttttttttttgtagagacgggggtctcactatttttcccaggctggtcttgaactcctggactcaagcaatcctcctgccttggcctcccaaattgctgagattacaggcatgagtcaccatactggctttcactgcacatttgaaattttcataataaaatgttgaaaaatttctacaggatgatttctaataaataatataatgcaattgaataccaattaaaaattgcattgacatgaatggtatcaacaaaaaatttaaaataaacacacaagtgaaaaaaatgaaaataatgcataacttcattgtcgatcacatttataaattaaaattaaattgatatttattctattatgtcttgaaagaagaaaataaattataatacacaaggtttttgagtgtgagggtgttgagaattatatacaatgtccacgtgcatataaatttgtacagccttttagaaatactccttttgaatatatgtctaataaatttaatgacattacctttgattcagcaattcaaattttagaaatgtattttcataaaacattgaaagactggatgcaaagatatatatccataagtttatagttatcaaattgaaagtatataacatacatatttagcaaaattatttgattaaatacatttggtataaataatatgattaaaattttttattgtattgtaagcactgatatagatttatatttatggacataaaaagatagccacacttttttgagtgaaaaaggcaagctatgaaaaattatgttgaataaatatgtgtgtgtatgtgtgtatatatttatatatgattgtatgcataaaagaataaacgtctgaaaatgtagaataaaataaaatttgctatctctggaaatgctatattgtggtcaatgtttactttccttttatacatttccttttacacatttcagtagtttgaaaagtaaaaataaacatttacagataaaaacttgaggaaatatttcacatcagatataatgaataattaatattcttaaagtactgagttcttacagttaaaaactaccaatagtcgcaaatttttaaaaacaatatttatttacatgacaaaatggtagtctctaggaaacacagagaataagaaatatagagaataagtattccttaccttccacatatttacaaccagtattcaaaaatagttttaaaaatatgtttaaccactctaaatgtacattaatattctatacacacaaatgtgaaatgatcacatcaaagtaaaactatttattgctttatatttacttactacatattccaagccatactaaaatgtatttaaaatgtaattctaattgcctaaagaaagcatacgagtttgtataaataaaataccattttcgtaaaatgaaattctaagataaatttgaattttgtttttttgaaaaggattataaataacatttagattatatcatcattcatgagttcaaagaagaaatgaaatctcctttgaatgtcgcaccattctgccctgattagatcaattttggacaatgacaatcgtaattaattactcttagccttcaggatgatgcacaactcaaaatacggaaaactgaaattctataacaaatacaactggctttacaacatctgaacaatttaatacatttaaaattacttaaatgaaaagtaaaagttaaagttattgactcaaaattttaatcagcttgactatccttctgcatctaaacatgaattaaacaatcttaaagctagaaatctaaccacagacagatataagtaaaaaagagaagtttaccagtttacttttttctaatatctgagttgaattagtctcttccaaagtattttttttttgcaattttgaatttactagttattttaatgaatgaagaaataataatgggatataatgtcttaagcaggagtgagtagaatatacaaaaatctaatctaagaatgggaatgagatattggatatttatttatgaaaactgaataactaataaaaatgatctcagcaaatatgcttaatttagatattgtgataatttcttgtgaaacttttgaagttaatgttttgagggaactttaaattctctctcaaccacttgcaatttaattaattagctatcaggcatcagtgatattcaaacttgcctccagaatctcatttatgagatttcaccctggatcacatttttagtttgtcataaaggttggcactctgcacaaaattggcaaggcaaaatatttattttcctctgtattcacttaaaaaaaaatactgtcacatctgacagaaaccatagtaacttctctctaaagttattctttctcaagttttttaccctttgtgctcttgacaacttttctgcaaatttcattgtaacagaaccaatacaattaataagattcctgctgtaactttcctcacgccttctatttatttttgtctgtttattaaaatagtactttttataagagtcgccctatgatattactgcttcttttaattactttttgaaaaataaatacttttatttttaagaagtatgtttaatcaaactcatcttaaatttattttgcgtaccttcaaatatgcagttatctgagataattaatgttttaatatggccaaacaaaatttgtgctttaaagtccattatctcagcgaacagaatggagtgaaaataaattatatttaaaaccacacacatacattatgcagaattttctcctttcagaattgatattcacagaaataaaatgccactcttattgtttagttggaaaatacaattgttagaaaattacatttcatcttatgtgtcaatctctgcagagaaaagcaaattagctttccctggaatgtgagaaagcagcaaaagcaaaacactctaaaattataatttcatattcttatatttttatctttatcttgctaaagaataagaatatattccactcttaaaaattcttgattttgtggaggaaacacattcagcaatctttagaatgatatagataagtgtcacttaattatgaggatacattctgagaaatgtatcattaggcaattttgttattgtgtgaacatcacagagtgtacttacagaaacctaaatgggatagcctcctacacacctagactatatgctatagcctattgctcctaggctacaaacctgtatgaggtactactgtacagaatactggagacaactgtatcacatggtaagtatttcaatatatttaaacaggaaaaggtatggtaaaaatacagtttaaaagacttaaaatggtacactgtatagggcacttgccacaaatagaatttgcaggactgaaagttgctctgggtgagtcagtgagtgagtgctgagtgaatgtggaggcctaggatgttacactattgtatacttcacaaacactgtacactttataaacagtgtacactttataaacactgtacacttaggctacactacatttactaaaaatatatttcattttttcaatgataaattaactcaccataacattttaggtttatttactttttatttactctttgacttttctgtaataacacttaggttaaaacacaaaaacattccacaaccgtaaaaaatatgttcttgctttatatccctattatagaagctttttcctttatatccttactatataagctttttataaaaattttaaaagatttattttcgtttgtagtttctaaactttcttgttaaaaactaagatacaaacacacatattagtctatgcctacaaagtgtcaagatcatcaatatcactgcccttcacctccacattttgtcccacagaaaggtcttcagaggaaataacacacatggagctgttatctcctatgataataatgccttcttctggaatacctcctgaaaggcctacctgaggctgtttcacagttaaatcttttttaataagtagaaagaatacaatctaaaataatgattaaaaacatagtatagtaaatacacaaatcaataacataatcttttattataaagtagcacataattatatttgcttatattttttgtatgactggcagagcagtaggtttgttttcaccatcatcaccacaagcatgtgactaatgcattgcactactacattaccatgactaccaccactaagagataggaattttccagctctattattatcttataggaccaccttagtatatgtggtccatccttgactgaaacaactttacctggtgtacaactgtacgtatccaagatagccaaaaaaaaaaaaaatctaatactaacattgtaagaactgtataaaatttaattttaaaattacatgaatcttttaaaatagagaatgtacccttgttactcctaatacttagctgactctcctttttctagatgagaaaaatatcatcacaattgcaaatcatcttaaaaggagattctcattcagtataatataatttcacttacactgaatatcactttttatttcctttattgcattatctcacatttgaaaggtttgaattgccacctggcagtgtattataatatcatattttacattcactctttatcagatatctaacatggaaattcaagttcatatttctttgcagacaaaaccaatgacaaaaagttctttaaacaatcagtttctccaaagctattctaaatacatttaatcctctgaatcaaatgcataatatgaatatgtatcatgttcataagcaagttacataaaactaaattgttatgccactaaaaatatataggccacatatcatgtgtctacacttatctttttgaatgcattgtgtttcaccttttgagatatagttcacacactggttataaaaatatccagcccaggctggaatgcaatggtgcaattttaggtcattgcagccttgaactcctgggctcaagtatcctttcgaatcagcctccctagcagttgggactacaggtgcatgccaccacgcctggctagttttttcattttttttattttttgtagagacagtatcttactaagttgtccagacttgaagcaaactcaggccacaagtgaacctttccccttagactcccaaaacactgggattacaaatatgagctgccatgcccggcctattaaactattccttatttgttggtggtttttcttttttggtttctttgtattgtgttgttctttttttcccccttttttaactattcttaacatatcagagtttgtctactcagatttgcatgacctcaaactcatagggattatttatcttcattagtcattaattgctaacaatgaaatctaaattggtgagggcagaaaaggatacgcagataaattttgttccatcatttagatacatttttatgtttatattttcctattatgatacttttaggtttctggagctgcagaacctttgtcaaaaggtgcattttttcattgcaaatattctaacctatgtgccataactacaggggaacatcctatatataaagcaaattattctattcaaatttgacacatgtcctctgtctctgacaatatttcaaagtcttcctaactgtactttatttaaaacttctataacttttctagttttattaacggattaattttcacaggatgatatgatgcttgcaatattcagcttccttatgatcaaagccaattctaattctgctatttactcacaagcatactaattactttttaaaatatcgtgtttataatgatcaaaatatctctctgtgtaactgattctttttcctagcaaaaagctcattagtagtcataggactcaataatgttaatattcccaggatgaatgatacaaaagattcattatctttatgccacactggaatcattgaactgaatcattttatacgattacaattatctttcaggcaatgtactcatataaatttaactaaatgcttaaatggcctgttgacccaaagggcactattagttttggcttgataatttaataaattaatgcccaggaaataatacatactttttattccacacttttctcttttattttttgaatcaaataaccgtgtgggtataattagaatattgaaaaaaaaaaagcttcctttcttcttggctacccttccttggtatatgcatgtcttcttcactgattatgatgaagaactgagagaattcaacctacataagttcattttctgtataattgcaatttaaaactttaagcagcatgcttccaaccagttttggtgaaactctaagaacataaataaattatttgaaaagtcagtataaagtataccttcagtatgaatataatatgggtatataagaaagactatttcttgttttctcatgaaatcctaattttcttagttttatgtttagttttctttttatagataaattccttaaagccctaagtcatgacaagcagaaaaagactgaaaagatttcgaattaaaattattttattgtaaaaattatattgattgatcagagacagttaaatattatatttacaaattccaatctgtttaaatgtcctattagtacacataaagttgtaatagtatggcatttgcgatttatcgcaagatttctatacctttacagtacagttctctgacattggctgcacacagcaatttcccatagagctttaaaaaatactaataaaagggcctcaaacccactacttctggcttaattggcctaggatgttgcctcatcatcaggatcgttaaaagatccccaagaagttctattcttgagccaagcttaggaaacattgctcaaaaggtatatcaacagaagaataaagtctaaagtgcaaagtagacatttgctttaaacttgtcacatttctcaaaatttatctagtaatatagaaaacattatttgcatatataagccatttaaaatggccctaacaatacttattatcttaacaatttcactagcaaagtccaaaagaacactcataatggtataaaaatatattaaattatttagacatagccagcattttagacagctaacaggatgttaaaacaattaatataacggtgcttggattggcatgtgtctttgaatgtaaaccctgtatatatatgtatatatatgatatatatgtgtatatgtatatatcatatatatttattatgtatgacatataatcctgggtattactattttaatcaaaagataattcagagctcatgaaatatgatgaattgaacttccttgatactgattcggattgttgtttggtccatctatctgattactgcttaaagaaaaacacaggtactaaatttaccatgaactgattaaattaggtgatactaaatttattatgcactgactaaactaattcttgcaagctataaactaaattgtatttattaactgcattatggaatagaaatattctcatgaacaaattcctaaccctctggaaaaataatactttattttaaatatttctattgctgagttaactaagcaacaactaaacattctacaatatgaaatgttaatatcatttaattaaaatacattgtggatattggtattacataatcactcattctacagtattaatcatagaagttttcttttcatatattttatagaatgttattaatctttattctggtatgttatttattataacttaaaaaagcaagtgattaaatttaaattaagatagtttatattagttgattgggaaaaaatagaattgctcatcatattttccctccttttaagtattttgttttttttacttattttactttttctggttagaatttcatcaattttatcaaaaatatgaaggctgtttaggtatgaatttttcttgagcattactgtgtaaacaagataaatatataaagaaaataacaatcttaaaacttaaattaacttttttctaaccaccccagaagtctctgtaaatgaaacagctacagaggcatctcagtttatagatggtttttgcttcaactatttccattgcacagatatacacgtctgtcttataactttaattttcttgtctttcttatgaatataacagtacatgcaaaatcacattatttagtgttggagaaatcaatatattaaattagaggtgtctggaatacaatagatgttcagaatattggtatatttgttgactaaattaattttattatttaatacggtggtgacttctccatggataaggtgagagacctagttgaatcctttctatgaatattcttcaagcaatcttgtcaataattcactgttcatcatagtaattatgaacataaaaaggaaaaacatctgcagtgtgggaaatctgaatttgaagtataattttcagtctggtacactgggtaagatcatttttaagtggaaaagaaagaaagaaatggaccctgaaatattctgtgtgtgagcattagcagcaattcaaatacatgatctgattgccagccaaacagaatttatttaaatatgtacacaagtaaatgggtttacatgatttagggtagtttttacaggtactaaaagttagcagataactttgtcttgaatgtaagccatgtgtacaacagaatgtaaggatccaggcaattcgtttaactgagtattgacttttttcaattatgatgaattatgataaagtgattaaaaacacactacctcggtcttcacataatatatgttttcatttgtaatatgatttcctactttgataacttcaaacctaatttttttatgtttttcatatggatggtttatggttattaggtaaaaatatttatttagattatgaaataaaagagcctaaattaataaagttggaaacttttgcatacttttcttaaacaactgaaaaagaagcaatttagttactacaggcaacatggtgtccatgattagtacaaaatttaattattcacaaagtgccaggcacatgggatatacaatacgacgtgtctttaaatttcacttatttcattttccattatctttaggtttatattatttcacagataataactacacatttcataactaaatctgaaatctatacaaatgcacattatgagtgtttttggagatatggacccccaaacagatggtgagatgctgaaaatttagactaccatataaaaattactcttgctacactgtacttcaccaaaatacacaggactagttaacaattacaccctaattaaagaatcttgttgtctggggtcaaagctttaattcatttaatgtccgtatatttggtaaaaatggtaatatgtatggatatctccagaaaagttcaccacctagcaatatctatgcctgtgaaaggatccagaatatgttgcattaaaaaattatatatatgttggatgtagtccaatgaatgtcatgactcagaagaaagtacaataaaccatgttccccatagatgaccagttgtctccacaaaatgtacatttgttataaaatgcataagaatgaactaggtgtacttaaaatggatctacataggtttaatctacttggcaagaaaaacatttatattattagatagagaaagtggttgcatcaattacagcaaataaatgacagtatttgttttttatttgtcattattcttaaatcctctagaggcaaaatggttaatgaaatacttctcagcctgcatttatatgccagccttttaaataaaatctgtaaatattcaaatacaatctatgcatattctgtagtaatctttaaagattatcaataaagttatagacataaacacatacatgcatgtttgtgtgtgcatgtatacacactacaaaggctagtccttgcaaaagatgagaggtatgttctcattgttcattatctattcaaaaccactagcttactgctacactgtgcagaatcaaacaaaactttctagaacataccaaaaggcgaaattcaatcatcgtgtttgctatttcaaaaatctgaaaaatgttgcttagtaacttgtctgcaagtaggttaattgaattcgaataattattttaaaatactttgcaaattactttgtcctttcatttttaattttacatctacattactattgatcaataccttgcttgagacaaagtttagggtactttgcagttttcatcttttgaacaagactggcaagtagtgggtattaaatgagcattggccaatttaaatgaatactctgaggaaaataattcatcccagttatccgaatattcaaaaccgagttcattttatttatttatatatatatatatgtgtgtgtatatataaatatatatatttagtacatatatatgtactctatatattatctatgtagacacaaagctaaatgatgtttactgtgccacatttttactgtcttttggataatatgatttttaattttttaaatattatgttttcttgagaccagatatatatatttgatttttaaagtatgttttcccccagggcatctacacgaatacttctcagatatggttacttagcaaaaaaagttctcagccaggtgcggtggctcacgcctgtaatcccagcactttgggaggccaaggcgggcagatcatgaggtcaggagatcaaagtcaacctggctaacacggtgaaaccctgtctctactaaaaatacaaaaaattagccggtcgtggtggcgggcgcctgcagtcccagctacttgggaggctgaggcgagagaatggcgtgaggccaggaggcggagcatgcagtgagctgagatcgcaccactgcactccagcctgggcgagagagcgagactccatctcaaaaaagaaaaaaaaaagaaagaaaaaaaaattatcaaatagtatgaacacaaattaatttgatgtgaacttcttgacacaaaattgtatcaagagttagaagaacatgttaatgcattagcatcaagcattaaacatttactcttacagtttttcagttttaagtaattaattttattaaattatatattttagtataatggaaggctgatatccaatttttaaagccagcttttattccacatgttttactcatttattctgatgtaatgacatttttctagtgttaatagtcatataaaatgtttctgctctgtgagtttcttcactaattcttgtgtttaagttttctgagtttgttttaattcactcaaaattatttgttcactctctagaaattcattactcttgcaaataatcaaatcactgtttaagacaattaatgtgttaatcaaccttgtttgcttcaaacaacaaacccacaagttagaccaattttaagactaattttattgaaccagagaatttaatatggcattattttcctatatgttttaagaagtaaatctttaggccgggcgcagtggatcacacctgtaatcctagcactttgggaggccgaggtgggtggatcacgaggtcaagagattgagaccatcctggccaaaatggtgaaaccccgtgtctactaaaaatacaaaaatttgctgggtgtggtggcacgtgcctgtactcctagctactcggaaggctgaggcaggagaatagcttgaacccgggaggtcaaggttgcagtgagccgagataacgccactgcactccagcctggtgacagagtgacactctgtctaaaaaaacaaaaaaaaaaagtaagcctttattttctaataaaacgaagaaaaaataaatacgtatatatcttagttcaatatttttaattcaattggtgactgatcactatgactaactaatacattgaagcttttaaaaatgttattatttccctggcttatttatacgaattaagtattgaatatgtgtataaacattaaaacaaataaaaattaaacatcatatgcagttacaacaaatgatttctaacattaggacatggatttttatggaaagggagaaatattttttatactttctttgatcttcagttcaggtgattttaaataatttaatgtgcttgtttctgcacatattcattaaacatcaagagtgttagaaacctatgtataactaagaaatgttgacctggagaaaaaaaatattgtttcacctcttatctatatttgatattaattcagcaggttgacaatataacaagagcctgtgaacgaagctattgatttacttatgagggacttaaaatatctagtttactagtgacagtcagaatgcaaattaatagagaaaaagaaactcacttgttacgacttcaaaaactattctatcattctatcacatatctattggtaaatgtttaatgatacctgaattaaaattacataaaattagcaaggtatattgataaatgtttaatgagacctgaattaaaattatataaaattagcaaaataagttcatatggtattatttataatatattttttaaatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacaatccccagagtgtgatgttccccttcctgtgtccatgtgttctcattgttcaatttccaccaatgagtgagaatatgtggtgtttggttttttgcacttgcaatagtttgctgagaatgatgatttccagcttcatccatgtccctacaaaggacatgaactcatcatttttgatggctgcatagtattccatggtgtatatgtgccacattttcttaatccagtctatcattgttggacatttgggttggttccaagtctttgctattgtgaataatgctgcaataaacatacatgtgcatgtgtgtttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccatatcctctccagcacctgttgtttcctgaatttttaatgatcgccattctaactggtgtgagatggtatcacattgtggttttggtttgcatttctctgacggccagtgatggtgagcattttttcatgtgtttttcggctgcatgaatgtcttcttttgagaagtgtctgttcatgtccttcgcccacttttcgatggggctgtttgtttttttcttgtatatttgtttgagttcattgtagattctggatattagccctttgtcagatgagtaggttgcaaaaattttttcctattttgtaggttgcttgttcactctgatggtagtttcttttgctgtgcagaagctctttagtttaattagatcccatttgtcaattttggcttttgttgccattgcttttggtgttttacatatgaagtccttgcccatgcctatgtcctgaatggtaatgcctaggttttcttctagggtttttacggttttaggtctaatgtataagtctttaatccatcttgaattgatttttatataaggtgtaaggaagggatccagtttcagctttctacatatggctagccagtttcccagcaccatttattaaatagggaatcctttccccattgcttgtttttctcaggtttgtcaaagatcagacagttgtagatatgcggcattatttctgagggctctgttctgttccattgatctatatctctgttttggtaccagtaccatgctgttttggttactgtagtcttgtagtatagtttgaagtcaggtagtgtgatgcctccagcttttttcttttggcttcagattgacttggcgatgcgggctcttttttggttccatatgaactttaaagtagttttttccaatgctgtgaagaaaggcattggtagattgattgggatggcattgaatctgcaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattatgaatgggagttcactcatgatttgcctctctgtttgtctgttattggtgtataagaatgcttgtgatttttgtacattgatcttgtatcctgagactttgctgaagttgtttatcagctttaggagattttgggctgagacaatggggttttccagatatacaatcatgtcatctgcaaacagggacaatttgacttcctcttttcctaattgaataccctttatttccttccactgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttatgttgtgtctctgccaggctttggtatcaggatgatgctggcctcataaaatgagttagagaggattccctctttttctattgattggaatagtttcagaaggaatggtaccagctcctccttgtacctctggtagaattcggctgtgaatccatctggccctggactctttttggttggtaagctattgatcattgccgcaatttcagatcctgttattggtctattcagagattcagcttcttcctggtttagtcttgggagggtgtatgtgtcgaggaattcatccatttcttctagattttctagtttatttgcgtagaggtgtttgtagtattctctgatggtagtttgtatttgtgtgggatcggtggtgatatcccgtttatcattttttattgtgtctatttgattcttctctttttttctttattagtcttgctagcagtctctcaattttgttgatcgtttcaaaaaaccagctcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggcatgttgtgtctttgttctcattggtttcaaagaacatctttatttctgccttcattttgttatgtacccagtagtcattcaggatcaggttgttcagtttccatgtagttgagcagttttgagtgagtttcttaatccggagttctagtttgatagcactgtggtctgagagacagtttgttatcatttctgttcttttacatttgctgaggacagctttacttccaactatgtggtcaattttggaataggtgtggtgtggtgctgaaaaaaatgtatattctgttgatttgaggtggagagttttgtagatatctattaggtctgcttggtgcagagctgagttcaattcctgggtatccatgttgactttctgtctcgttgatctgtctaatgttgacagtggggtgttaaagtctcccactattaatgtgtgggagtctaagtctctttgtaggtcgctcaggacttgctttatgaaacttggtgctcctgtattgggtccatatatatttaggacagttagctcttcttgttgaattgatccctttaccattatgtaatggccttctttgtctcttttgatctttgttggtttaaagtctgttttagcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggaccatttagtccatttacatttaaagttaatattgttatgtgtgaatttgatcctgtcattatgatgttagctggttattttgcttgttagttaatgcagtttcttcctagtctcgatggtctttacattttggcatgattttgcagcggctggtattggttgttcctttccatgtttagcacttccttcaggagctcttttagggcaggcctggtggtaacaaaatctctcagcatttgcttgtctgtaaagtataatttttatttttaaatgtttccttgatgtgtctcttttactgagttctaatatgatgaatcaccaaatacagataatcatagcattcaatgaagagaagttaagtgagttaattaacaggtgtttataaagctgtggtgttatgctttcactaatctttccttgtggcaaatattgtggcacattatagaaaaaataataaaactaaacaaaactaaaaataagcagttcccaagtctccaagcacaagacagagatgtctataaatttaactgaacaacttttccagtttatgtcagcaataaagggatatctaaatggagaccagaatgagacagaatcgtttgtccttctcagctgattctctctggggctcactcttctccccagttggttaatccattgttttcttcacacaggttagacacagaggagaacctttggagatgagaaatttgaactttatatttttcttctttatttctacaggctacactgaaaacagttgctctgtatcaggttagccataagttagagcaccaacttaaattaccttgaaatacatcaactttttataaattttctgatttagagatttcaaaattacttctgctattaatcaaattttccttagacatgttttccattattattgtaatattatcattattaaaataatagtagtagctacattcttttacacattattcaattatggtaagtaatttgcatattttttcttatttaagatctatacaacagttttatgggatggtggtgttaaaattatttttccttggaataataagaataaatatttgggatacctggtttggattactgcattggagaaaaacgtacttcaaagcagactatcattgttaagattgttgcatttcttgagttaatcaagagtaagaccacatttttaatgaatatctcttactatataggaataatctttcttttttttttttttctggttttgaaacagtatctctctgtcacccaggcaggagtacagtggggcagctacagctcattgcagcttcaacctctcgggtccggtggtcctcccaacatcaccctcccaagtagctggaactataagcatgcacaacaccacccgactaattttcaaattattcgtacagctgagatctgtctatgttgcccaggctggtctcaaaatcctgggctcatgtgattctcccacttcagactcccaaagtactgagattgtaggcctgggcctccaagcttggtgattctcctttttaataccttaatttgagatatggccaggcaaacagtagaccttacttctaattacagaattgggaggaaagaaagagtctgagctctgggcacacaagctgatgcagttgatggacaatgtcctgctggataacctccaaagacttggttgtaattttctcaatctccatttttcataggaacctagtagaaagcaggggacagcgaagtcatcatccaggaggaactaacatgaaaaacattttgcatatatattattattttaaaatcatttgccttaatttttaaactgcttatataaaatgaatgtttatcccttgaaatgaactacattaaaatttaatgcagatatttcaggtggcttcagctcaaaataatttgggtaatttttaacagttgtttataataagtaaatttatctttaaaggacagctgagataaataatttttatgaatttacacttacaaatttttagtatagtgttgtgcctaggggaaagtttaatacataataggtattcagtaaaaactttttgaaaaaaaaattgaagcgataaaaggttagcctggatttgccatttaatcagttcagttcagagtcttgagtatgtacatatgaatcattgttaaataaacatggaattattttgtgaattaaaactaatgtatgtacatttcttagatgatgtctaacatgcagtagacgtccagtgagtcacaaatggtgcatagtgtttacttttggaataaagtgagacagaagacaattggtattttctctgtctctcttgtataacctagcataactcacctttcttgaacataggctcatgttgagtgggaagcaagggagtaatcacatggaagaatgttctgctttcaggaattaatgcatcctattcctaaataattaactacaggtaagtatatgatagatggatggatagatagataggcagacaggcagatattctcaaacagcaattaaagtaaacattacaacttaattcaatatctcatattacagttcaagaatctgagaaaatattttctaaaataatgatattaggcatagaagagacacacttagtggctatatagaaatctcaaacttatacaaaagcaataaaagttcccctgatagatatcagtatgggaatgttatgtttacattaaaccctgtattttaaaatgacttagtattggggttggcagttttgcccccttaatcttcaatcccttgatattgcacctatgaatatgtcagcttacatgctaaaagaaactttgcagaggtgatgaagggtatgatgaggagactatcctggattagacagtttcagtctaatcactctagtccttaaaggaggagagccttttttcagctgaattcagaaagatgctgtgatggttaatattgagtgtcagcttgattggatcgaaggatgcaaagtattgttcctgggtgtgtttgtgagggtgttgccaaaggagattaacatttgagttagtgtgcatagggagaggcagacccaccctcaatctgggtgggcatcatctatcagctgccagagcagctagaataaagcaggcaggagaaggtggaagagcagacccgctgagtcttcctgccttcatttttcttctgtgctggatggttcctgctcttgaacaccgaactgcaagttcttcagctttggaccttttggacttacactactgtatgtcaggggctcttgggcctttggccagagactaaagattgcactgttggcttccctacttttcagattttgggacttggactggcttccttgctcctcagctttcagacggcctactgtgggacgtcaccttgtgatcgtgtgagtcaattctccttaataaactcccctttatatacacatctatcctattaatgttgttcctctagtgagccctgaataatacagatgctctggaaaagggagggaggggagaaattcaaagcctgagaaaatttcaacctagaggaagggggctgttatacagggaaagtgggctgcctctagaggctgagaagacctcaagccaattgtcagaaggaaaacagggacctcaatctcaaaatcaaaatgcactgaattctgccagcaatctgagcgagcaaggaaacagattatcttatattccccgaaaagccatggtactctgtcaacatttcgacttcttcctggggagacttggagcagagaaactagctgaaatcaccaaattctgacctcttgaaactgtgagataatctatttgtgttgttttatttcactaaggttgtggcaatttgttatagcaacagaaaactaatgcaggcataatggaggattcagataattacaaatttatccagctttcatttgcttacttttaaatctttccaatatgaacaacaaaaacatgttaattttgtgacttgcctcagttaacaaaaggaaagttctggtgtgaaaatgtcaatataataccgcatattttaggcaaagagaggttgtgaaatagtctcatataattataacatacatgttttctatttttatgtttactgaataaatgaaatttaacgagtttgagttaagtttctgaaaattaaacacaattgcttatatgcaaattgaaaacttgcatcaaactattttgttttgttttatatttgaaattacagtgacaatgatttccatttagctctaaagccattaagcaaggcaaatttctcaagaaaaggttcttaatgtagtccctgaagttaaatgtaacaattgtctatctaaaattgctcttggaattctacatcgcaataatcatttgcaaatgtaatatttttcagttaccaaaactattttatctttactgaactttcctgtggatgttctgaaattattccttcccttcctttaattgcagatttttcaaatgtagcttccagatagcagcttccaggtagcaatcatgatctaaatcactgaagcctgtgtagtgatgtgtatagtctcttagtccctaagaggttccacaaatatcatctcctatacacgttttgaacctcctagacgatgatacaaagcacttatagtcagactattcagtcctgggagatttttgaggtctaaaatctcacagtgattatttggttcttgtatttgtagttcatcaagtcacacagttcatcaaattcatttctggctcagaccttgccatatttaggggctaaaacagagccactacctagagtttgcttgaattctaaggccaagatcatagtctttgttttcttgttgttgttgttatcttctatatgcatttagtaatctcatatcactgggaagtctggaatgtccaaaagcctagatgatgtactgtggaactcacatgatccctctgataagggtgagagtctatacagggatagatacaatgaataaactaaaccttaatccactccctgtataattgaatctgttttaaacaaaccctaattttttaattaaagctcctctgatcattgaaatcaattgtatttgtttacctaaaacaagccatggacccgaataaggagtagattagaatacagaccaggaatggagtaaagaggtcaaaagtgaggaatgactaatttgcaaaataacaaattcaaagatagtaacaaatatcccagcctcaaagttgtaattaataatgataataatagtaataatagatatatattgactatgtgtgtgctcggcagtgttttatgtattgtatggactcataagaacagagagcccctggctcaatggaaatgggcatattatgtaaaaaaaacacacacacacacacacaaaaaactgtcttgttaaaaaccaatatatttcaggttttcttttctttctttctttccttctttcagcctgcctttctttctctctctgccctttctttctttctctttctttctctctttctttcatctctttcctttcccagtttatcttcatataaatattgattacctgaaattggtgctactgtaacaatgacaataaaatgcacagtatttactttaagtctgggcagtaaacagcaagggaactcttactggaggctgtaagaaaggcaatttgtattacgcaagagtgaaacataaaactgtcacttgtgataccatgaaagagagaaaatatcccagtgaacttgtagctttaggtcaaaagttgaacaagtttaacaaagagaatttgtgatggttgcatttgtaatggtactgagaggtgacagcgtgctggcagtcctcacatccctcgctcgctctcggtgcctcctctgcctgggctcccactttggcgacacttgaggagcccttcggccgccgctgcactgtgggagcccctttctgggctggccaaggctggagcccactccctcagcttgcagggaggtgtggagggagaggtgcgagcaggaaccggggctgcctgccgcgcttgcgggccagctggagttccgggtcagctggagttccgggtgggcgtggtcttggcggccccacactcggaacagctggccagccctgctggcaccaggcaatgagggacttagcacccgggccagtggctgcggagagtgaactgggtcccccagcagtgccagcccaccgatgctgcgctcgatttctcaccgagccttagctgccttcccgcggggtagggctcgggacctgcagcccgccatgcctgagcctcccacccactccatgggctcctgtgcgcccgagcctccccagcgagcaccaccccctgctctacggcgcccagtcccatcgaccacccaagggctgaggaatgcgagcgcacggcgcaggactggcaggcagctccacctgcagccccggtgcgggatccactaggtgaagccagctgggctcctgagtctggtggggaggtggagagtctttatatctagctcagggattgtaaacacaccaatcagcaccgtgtgtctagctcaaggtttgtgagtgcaccagtggacactctgtatctagctgctctggtggggccttggagaacctttatgtctagctcagggattgtaaatacaccaatcagcaccctgtgtttagctcaaggtttgtgagtgcaccaatcgacactccgtatctagctgctctggtggggccttggagaacctgtgtgtggaaactctgtatctaactaatctaatggggatgtgaagaacctttgtatctagctcagggattgtaaacgcaccaatcagcaccctgacaaaagaggccactcggctccaccaatcagcaggatgtgggtggggccagataagagaataaaagcaggctgcccaagccagcaatggcaaccccctggggtccccttccacagtgtggaagctttgttctttcgctctttgcaataaatcttgctactgcacactctttgggtccacgctgcttttatgagctgtcacactcaccgcgaagatctgcagcttcactcctgatcccagcaagaccaggagcccaccgggaggaacgaacaactccagacgcgctaccttaagagctgtaacactcaccgcgaaggtctgcagcttcactcctgagccagcaagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccaccaattccagacacagtactataggaaagagatgagcttggaaaataattcaatggttttcatgcaaaaatatgatggcattgtttagaattttaggggtgtgtagggttgaaacacatttttaaccacaaccattaaaaagcaaaattgagaaatgatttgatcagcaaaggtcaatcaaaactcagattcacagtaaagtcaagtgtatgactatcacactcactgttaaaactatacagtagtttaagatgatgctcagtcaatcctttcagttcaacaaatagtgcaaggaaatgagactgaaggtaagcctgttctacagattcctggcaggatcaaggtacccaaaattaaatctaaagggagagtcatatcattaaaagaatagtatgttttataaccagaagttatgacacacacacaaaagacttgaatctttaagggggttattctgaagctgtcatcacagggttaacaagaattctggacagaaatatagttacaagtatgcattagtcaggctgcaatttgattcacttccttgtaaccaaaatcaaagtcactagatatcgaccatttgcatgtccattgttcttctaggtaggatatctgaagttagaatcataagacttttaagaatcctgaattccagcagaacagctgatgccaacccgaaaaccccacatgagaactaaatcagcatgagaatgcagtttcttcttctccctgtctcatgactgcaccctgcactcttcaactaatcaacaatctccacacatcagtccactccaaaacctttaaaaaccctaccctcaaactcctcgagaagacggccttcaggtttcctcctgtctctttgtttggcggccctacaattaaacctccttctctgctgcaacctgatgtcttggtgtattgatttgtcttgtgcatagggcaatgggcaatgaaccttttgaggctataattccactaagtcatccacctctctggaataaaaaataaaatgacctcaatattctaaagatgtaaaacaagcctataaaaaaatcctgcacagcctccagagaagacaaattctcaaattccctctttaagtgaagacaagaaggataatagaaagttaaagaactcccaaaggtcaatcccatggatgatggagaacaaggtacagaactggattgctaatcctaggaagtgaaattagggtctaatcaaggaatacacttccagtgtaaaagcacctcataaattccacacagctggatttcagaattgctgttgaccaatgaccattatatctcctgttcttcccatgtcaaaatggtcactgtggttgtcttgtgtctgcttcactatgtaatatttggtaggggaaaggggatcattgacacttaggtcaataggaatcacatccagacttcatttagagactatcacattacctagattcacggattttagttagatactaagattgcttgggactttgtgttccccccgcctggggaaacaggagaaacaggagaagtaaacagttacaccttatggaacatcttctccattaatattttcttaatagagcatttttctgctttttctatccaaacttagtagaacttacatatttctcaatgtaaatattttgaccaatatttatctaaaaaaatttcaaaaactcaacagcaatattttagcaaaaccggtatatgtgaaagtctcaggttgcataacaaatacatttgacagaacttctaaatcatatgcagatatcttgaaaacttgcagagtatcaacaaaagaaataccattcttatatgaagcacatcacagtgtcattgtcagttaaaatattctctgtgactttgtacttgtgttgaacatcttgccacattactttttatatttctatagtacttgtctaaaatagtaaaacaagtcctccaaacaataaagaaatttgtataaaaattattgagaaaagctgtatcaatggaagaaaacttactgaatgcaaaagaactgcttgttaacaaccgtattgtttggtagttaagaaccaaagatgtaagcaatttatatacttaggcaatagttcataatgtgtattctttaatgcattttaaaaagtaatatattggttgtaaatatttgactgatgtgtaactcattaggaatatttttcatttaaattattaagaaataggctacttgttagtattttcacacataaacctctaattcgcaggaataaattactgtgattaatgggagacccctgtaaaaaagaggatcaaccaagtttttggtgacaatgaagacagatgtgaccattatttgtgctgttgaaaaatatcctcattctccagcccaccttctggacacaaggtagttgcacttcctgaattctgtctggaggatggggctgggtggtgagtttcagtccgtgaggtggggtggaagaatgcatatcatttctggaccaaagtacttaatccactatgatatcctccagtgtgttatttcctccagctactgtgaaaagtaatattagctttggtccttgaatgaggatggcatatacaccagatgggctataatggacacctaacatgaatggaaaaaaaaaaaaaaatcctgtgttgttttccctctgtggggcaagtgggaggtgagttttacttgaaaaatctagtctgatctctgtttctctacaacttcattatgactgaacaagcacaaatactgtcatctctactctgatttactataaaagacttgtaattgatttttctctttcatgttcataatctgcaagtcttctttccatagagggagaataaatttttttaacatgcaaataagattgtgtcagcagttctaatgtgcctatggataattcgagtagagtataagtaaaatttactagtaggtgttccaggaactgtgaggccaaattttagaaagtccattattatggatgttagagttcccaagcataaaagagaataatgaatggaaagaaaggttataattcagttagtggctaaagtcactgaatatgtacaatgtggcagacactctttagttctcacatcactctaattctcttacaacttctcctactttatatatgaggaaatttaatgacagaaagattatggtaaacaatatgtcttaggtaacacaattgttaacgtaatagaagtgggattcaaacttgccacagagcctaacacttaactgccaaaaaccaaaaaaaaatcctgaaagttctatggacagaaccaataaaaagtaggcaaaatgagctcatgaggagtttatgaaagtgcctgttacaatgctgaatgcaaagcaactgcatgctttgtacttatattcttatctggatgctttataggtaccagattttctctgctcgttcatcagtagacagatgaatgttcctgatttccacttgacaagttaatgcattttggaagtgtaaatactcaaataaaattcaaaatcaatgtctaataaaatttttctgagcctggactccaccactagacaacgtatgcatgtaagaaatccgcacttatactcactaactctataaagacaaaaatacaaattttcttctttttcctatagtataaagagctcccttggtgcgggtgagcatgttattattcatgctctatcatattccaaatttcattttatgctacaggttagcatatcaattactatcctcattttccattgaaaggtcagcgttgctgtttgtgtggtttttgagcagaagaaatatgcattctgaacagtgttataaatgtattagttattccttaataacttattatgctacttggatgactataagaatgtaatatataccactaggtaagttatattttctcaagtagaaacaaagaattgaaaaactagaagattatcttatgatacctagtttaacttccatgttccataggtgaagaaattgagtcccaagtaagttaaataactttccctgaatttcagaggatactagtaaatagggataaattgaggaccataactgagggcccttgaatctgtgttccatgtagcttatgtaattaataaaataaaagcctcaatgttacacagcaaatatgtctatctacagaaatttattaaatagtatttttaatagtaaatgagaagtcaaaaaggttggctcatataaagatactatataaagtatttttcttgctaccacaacgtaatcattgcattgttagggttgtgttttctctgaactatccatcataagatttattttttgacttttgtatatctaatgctttctcacttagatcttctagtaattcacatctgagttcactttgctctcaccacttttctaagcagggttaggctacaatggtaacactttaccttcttgcagtgtgctatatttcattttgtaattatatgaaaagacattgtaaaaaagaggaaagaaaagctcaatgtattttacagaatgcattttgtgccaagtctgaagtaccacatacttgtgaataccagagagttttcaaagcattttcattttatttcacattatttcatttaattctcccactaatctgtagaggtaggcgaagtaggttttaatgtctctgttttatagatgagaaaacttgtcattggaaggataagtgacttgcccaagttcacactggtattaagtggtgaagctgtccattattcagtgcttctccctctacagtttactgagataatcagtgttgcttaatagtagctgcctagaatacatctactataattatgaaatacctaccctcaaagccacaaactggcccttttccaatttctcacacttttatagagcagaggtcagcaaactaaagcccacagatcaaattggagtccttcctacttttgtaaataaagtttattaaaacacaaccacagtcattcatttacatattgtctatggctgttttcccgctgcaatggcaaaggtaagtagttgggagaaaggtcacatggtcccaaagtcttcagtgctcttcggcctttgccttgaatgtgtgctgacccctgctagagaatatgaaaagctaaagtatacttccagactcttgcagctattctttcagaaactacagaaatctctaagtaatctttccaggaaatgtttttaaaataaacagacttgactggcttggctcttcttttctttgtccctttcctatatttgcttcttccaacctgtattgtgaacaacacctgggattgcagtcattacttagtatacatgaagagacaaacatatggacaaatgaggacggatagaaagaaaacagagttagggtgcctaactacatttctgagcaacttcttcagccctggacttcgtggatctataaaggattctctacatatgaaatacactgttagtagtgttacttgattataatttaaaaaaattataatggatgcattcaaatgtcctgtcatttactgagtcataacaatagtgttagcttccatgttaaggccactaaatattgaatcactttaggattcagcattttactcctttatctacacccactcccttagcgatcttatataacctcatgaatatacagtgtttatgtgatgattaatcttaattctatcacaaggccagtcatctattcagctagctactcggcaactctacatggaagtttatccatatttcaaacttgacttctgcaaaacctgatcctcttgaagatttccccattccagttaatagcaatttaatgtttcaatgcttgtgccaacaactgtggagtcatccttgatttctctctgtcatctacattccatatttttagcaaatctagtcgtaaccccatcaaaatatttcctgaggccctgcaagctgaagcttagtccttgttatacaggtgagaagaatatgtcagattgccagtgccttcctcttctataactaaaagttctttgagtctaacatctggataaattgtgcccaacattaaacttcatttttcttctgtctctatagaaatgcctcttattaaaaatcaatttgccttcatcacagacagaagcctagaccacctgagatgccatctcctcatattggaaacagctgtttaactgaactgatctagtttcaggactagtctgcagttcatttaagtgctgtgctaaaactgttggtaaggttatcaacatctttgtcacataagcctaggaacactaactgggaaccccatgagtagatgcagataactgcaaagtggttttatttttatttcccttgtgcataacccacctcaaccccacaactatgcctcttgtcaacaggaagaagctagagtgaccatcagccttttcccatctctatagccaacaccttaagagtaaggtgctatggagcccaaagcagggtttaaaactacctttgcaaattatatcagggagaaaattatgacagtaaaagagatctgatttaaccaccccgccccatcttgcctttcccttcaacattcctgagcttaggctaagctaactttgagagacatttagtttatatgacttttatcttattttgttatttttatagagatgaggtctccctatattgcccaggcttgtatcaaactcctggattcaagcaatcctcccaccttggcctcccaaagtacaaggattacaggcacgagccacagcacccattcaatataaaatttagttttaaatgataataggcctcccccaaaactcaaccacctttgtaaatctaatgaaacattatcaggctagggggaagagctaaggtgtggtctgatcacaagatatgcaacatcactatagtatattgcccttttgagatatttgttcaggttttttgcctgtctgacacctggacctgattgctcctatggctccacatggaagcaactccgcttaagaggatagctgtgccctcctacaatttcatctctgcctgaaccaatcagcagcaagtacccattacctggccaccccatcccttccctcaaactgtctttgaaaaactgctaacctaaaagcctgagatgagattgatttgagtaacaaccccatcttctgtgtagtgtggcaggccttgtgtcaattaaacttttcttcagtgcaatgccatggtctttatttatgcagcgggcaggaagaactgatcaagcaattatccttctactcttgtcttatttggcctattctctatacctcagtcagaatgacccagtaaaactgaaaagaagacaaggtcatttctctgcgcaaaatttttcaatgatttgctgtctttcttaaacagaagcgaaaatctttgacaacaacctacaaaatgttttgcagtcagtcccacttcctccccaaccctaccttgttatttccatgacctcaattcatattatagcctctttcattcattgtcctctggctacacttttttgcttgcttgtcttcctgaacatgccaagcattctcctgcctggaagtctactctggttattctttgtttgcattgctcttcaaccaactagctacatggatatctcttctcttgcaaatttctgctcaaatttgattacctcagtgagctcttccttgactattctgtataaaacagccaacaattaaccacttcccttaagatgacagcaagaatgaggaaaataaaaataaaaataaataaaagcataaaagattatccacttctctttcccattagtacttcctatattctctaatcttccattctttatttctatcattaatgttttattatgatatataatttatgtactataatatacactactcttaagtatttgctttttctccttaactcatgtcttctatgacactatatactttacttttatttatttagttatttattttttgaggcaggatctcaattctgtcacccaggctgcagtgcagtggtgtcatcacagctcatcaatgcagcctcaacctcccagcctcaagcaatcctcccacctcagcctcctgaatagctgggactaccagtttacaccaccacagttggatatgttgtttttttaaaaaattttgtagcgatggcatccccctatgttgtgcaggctggtctttaagtcctgggcttaagcgatcctccacctctgcgtctaagattaaaggctaagcttaaaggcatgagccaacacacttggtcacatttatttattatttactatatgtcttcctgaatttaatttaaaaacgataaaggcagaaattttgtttgttttatttgtagagaacccacagattttttagtaagtttctggtgaataatttaatatgcattttctcatttaatcctcacattaatgagttatttcctccacagaaaaaaggaaaaaactcaaatttattatatttaaaataattggcattggtcacattgctagtaactagtgatggaagtgacgaccagtgtggagcagctgctgcaaggatgctggttgcacagcatgagacatggacagggttgcatgttctgcagagctggtgggagccaggagcaggcgagagcccagacccctacttagttgatgaggcagaagcccgtgctccctggcacagctgcagccacccagctgtggcgctggactctagcatcactgcactcttgggggcccaggaagctacttgccatagcaggcttgaaagtacctgctcctgctccctggcctctccccacttccagcacccactctggcatggagcaaagttgtaaccaagcctgggcactgttgcaactctaacaagtgtgcgggcactcgggacagggctgacacaccagctccctgctgcctcagcctcctccagacttcgggcaccaacaagcacaggagggaggctggcgggcgtggtgagtggtgagagcagctcagcatgggcctgcagcacccctcaacacaaacagcctgggcactgtggacagcatgttgatggtggcaagaagcagacaggccctcgggtggaaaggggtgcatcccaggtgaaaccccaccttcaaggcagggatggcctgaagcctgggggccgggttgtcagttccagctggagtccactacccagagtgagaacttacggtgcttttttcgggcctgccaatgacagcccatggacaaataagcgcatatttcctcccttctgagcccactgaaaccctggactcagccagactcagacatatgtcaggactaccagctgtgggaaggaactacccacttcaggtctcctggagtgataaggatgacctgtctgcagaaaggagcgatccactaggggtctcctctgagctgttctgttgctcagtaaagctcctctccaccttgctcaccctccagttgtccgcatacctcatttttttaagaggcaggacaagaagtcaagaccaactgaatggtgggaatgaaagagctgtaacacaaacagggctgaaactccccccgatcgccatgctgtgggcgatgaaaaggagagaagagctgaagaggccctttggggacgccagacctaggggctccccgagccagggccgtgacaccctctttggggctctgtggttcctggcgtctcgaagcttctgggtgccaccgcagtcccctcatccagacacaggtgcccacagtggaagctgcttgtggtacatctgatccagccacagccttacacagagcccgcacctgtgccggtgcctggagctgcccaccgcgctgcagcagccagcatgcctggctgtgcgcagtgggtggaccccacgctcactttctcacatatcccttgccactccatgcctggcttacccttggccggcgtgggatcctagccggtggtgcaagccaagcacagcctggcaggctgactgggcagaacgagccagtgggcccaagcaaaactcaggcaaacgtgccactggccacagaggtttccagctggaaaagcaacaccctaaggaactcaagacagcagtgttgccaagattttaatttagaaattgtgaagtcacacaataccctcttaattaccatgctctatattctcctagctgctctgtagaaaaaagttcagacaaaacaaatagtaacatgattgaaatggagattggcaggatactagaacaagcagatatcaagctacttcagaacaatatcctcttagttgccaaatctaagagaaaaagtaaataagctcataataaaatacagagaacaaaaaacctgagaatgtatgattaagataatatcaatatgagaaaatactacatttaaaactagttgtcagtggaaggaggagtagagaaaggaagagaatagaactctattaagtcaagtttcaggaagaattttccagtctgaataaataagataagttattagggaagtaataaagggtcacttctagaagaataaaaacctgtatatgtttatccattaactcaaaaaaaaattattcaatcctttcatcttgaaagagaaagagatgcatttaataatggattatttaaatgcatctctttctctttccaaggcccaaataatgttatcacaaagtaacaccaacaatgtgaaaacccatagaattgtgactacaaaaattgagatatttcagcacacttttagcggatctaaagtgaatttaagaggtaggaaccatttagtagagccaaaaacgataaaacctgaaattctctagagtaggatgttaatgaatggtgaaagattctgaataaggaagcaaaaattgccatggaaagcagggaatgaggcaagattataaaaacacagaacctgttttttcctcaggactcttatccttacctcaagtacacaggttccgttgctgtttgagatcagtgttttatttgctaaataaatatggagcagaggatccagacttgactccccaggtgtaagagaagagtgaggcacaaagctggaaaaaaagaaataagaaaaattattttatctttcagtttcttctcatcatccctaagctctcccacatcttatggagggatataatcccctcctttcagattagccagtatcctgcctttagctatagtcctacatttattgtctgtgtaattactgagagaaataagatggtaattaactttcaaaatgggcagtatacctgtaacaaagtctttgaaagcaactgacatacaaaaattctacaaataaaagtaagtgtaagctcaaataatacaatagtacattatttatagaataatgcttttcccattccattgtattttaaacctatgaacccaaatgccatactggaaagaaatgttagggaaatgtcagcagtaattcagtgggtccatgaaagggcttcaacttggcaggaaacctctaaaattatatgcaggatcatatttgtattttcatagtgatggttttcatgagagtatctctaaatgaatttcaaaaataattctttcattaaaaagagttttttttttcctttaggaaactttttaatacataggctatccgtgaaatatgtatatgtcttcagttgctgttgaaagcaaaatcagctactcctctgtctgaaaagtattttacttcatcttcattcttgaagggtattttcaaggcatatagaattcaaggttgggagttttgctgttattgttctttctgtgttgttctgggtttttatttggcatgttgagaatatcattttactgttttctgacttttattgctgctattgacaagtcacctttcaacttaatattttctcttgggccattttttaagatttttttatggtgtatttgatgaggtacagtttcattataatgtttctagttgtggatttatttttatttcttttttcctgaaattacttaggatccttgactctatggatttctgtcattgaccatttctgaaaaattatcagccacaattttttttttacccttggccagtaaaatttattatctgtgccctatttctttttttctcctcttaggacttctgttgaaataatgttacattttctcactctgtcctgtatatactttattctcttcctgtattttccttttatttctttgtctcccatgcttgtggtgttttttacagtgtaaacttagcttagctagaaatatgttttccatatgtgcttccctatatgcttccaggttatagtgggccaaaatagaagttggtacatgatttggaaagtggagaggaagcaacagccataacctctgttggttgttttggtgttaggctgtaagaaccagaagcatcaacgctcagagaagcaaattcaaaattaaccatactcttcccaactctgcatttgtaatattcacctgctagccctattgaccaagagtgacctcaggcctactccatctcagatgcaaaggcaataccctgacacagatgtctccactagttctccttaatggtcccattctgcaagtcagccatgcctggtttctgagatctctggcaagttctaatttgtccacccatactggttcttcagagaggaggagagcaaatttttctgatcctctaactcacccattctgacccttacttacccagtgtcttgtgtagttgtctaaagttttagtgctataataaatgtcctattctgtattacttacagtggtagtgctcacatggttgaactttgtctgtactgcgtactgttttactgcactctttttaagaacactaacttcacatccttgtatataattagctatgaggtctatgcaatgaatttttaatttattaaattttggagatctttatgttctttatatccttttttacatctgtagcatcacattttatttccctgtttctgttgatgtccttaacttttgtctttgacttctttaagttaaaaagcttaagagtttcttctgccttgacctcctgggctctagtggtctttctggcctggaattagtcatctcacagagtaatccacgaaaagatttagaaacaactgagctcgaaccaaagcttggaccagttcctaagtaataaataagttctccttgtttaacatcacactagattgtaaagtccttataaaaaatagatttgcttattttatccataactgaatatatagggcctcgaggagttctgagtatctgagaggtactcaatacatatttgttgaataaaagcatggccaaaaaaggataaattattttgtgctctccctgatgatttcaataggatgtacttctgggtctatttattttgttgtttgtgtttcggtgggtacatgcttttggtgtgtttttactttatgtacctggctacctttgatcgagctaagcattacacataattaactgtataattaagcataattaagcactgcataattatttgtaggaataattagaggactgagatgaaggaaagccttcatccagagaggatttctgtttgtttcagtcaacgggggcattacttgtcctcagtcacattcaacaatttgaatacgttagattactgaagcctccagacttttaaaattgggctacaattcttcaagaaagccaatcattttatttttttttattcacctttgtcccaaaggtgtatttattaggtagcaacttattgtgggacacttacctgttagactcttcattttgttctatattttttaactatagataggtcaatacaaatattcacatttatgtaactaacaaatacttctattagttctagttttccctgtgatttcagtctaataagtatttcttttcttacaagacctgcagtgattttaagaagatattttaaaatatatcttacgcagatttttagaagtttttaatagaattgtttgtacaaacaatcctcccattatgggaaacacctagcctccagaaaataactttaagaataatttagagagctttgattaaaaatgtagataggaggcaggactagcttgcagttcctgcttggacagacagagcagtgtgtgaagacttacatcataaaattttgctccaagaactaccacaggaaaataccaggaaagctgagagaattatctgaccctttgaaggaactggattgctactgcaggctccctgagatgccaaaacattgtgagtgtacttgctttctcagcagggatgctggtggtctgaggcaagttctcagccctggtcaccagctgcctaaaaatagactcagtgttgttggggggacacagtgggagtaagactggcctttaggactgtgggctgtgtgggagcagggtgagtcctgcgactgctgactttcccccacttctttggtgacctgtacgactcagcagaggcaacctaatacacctgggaatataactccattggcctgggaaccacattcccattccacacagcagctgcagcaagccccacccaaggagagcctgaactaagacatgcctatccctgctaccacccggtggtctttctctaaccagtgtagttgccaaagaaaaaggacataatctcttgggagctctatggccttgtccactggctgagaaacctgaatacttaaccagacattcctagggcaagtttgcatcctccctatagtaccacagctgatgcactcttgaaagtgccacctcctgcctggagggcaaccaacacaaaaccagtgcactgaacaaaaacacaaccaaagaccctcacagagtccacctcactcccctactatctccaccagagcaggttactggtatccacagctgaaagacctgaagatgaatcacatcagaggactctccagtaccagcccagagctcagtacctctgcttggtggctagatccaaaaaagcgaaaacaatcactgaagttcacctctcaagaagccctatccctagggggagggggtacaagaataccacatcaagggagcacgcggtgggacaaaaaaatctgaacagcagctcttgagtcccagatcttccctctgacatagtctacccaatgagaagaaaacataaaaacaattctggtaacatgacaaaacaaggttttttaacacccttaaaagatcataccagctcactagcaatggatccaaaccaagatgaaatctctgaattgccagaaaaaaattcagaaggttgattattaagctcatcaatgaggcatcagagtaaagtgaaatccaacttgaaatcaaaaacatgatacaggttattaaagaaaaaaccttcagtgaaatagatagcataaataaaaacaatcacaacttatagaaagaaggatacacttagagaaatccaaagtgtactggaaagtctcagcaatagaatagaacaagcaaaagaaagaacttcagagcttgaagacaaggctttcaaattaacccaatccatcaaagacaaaaaagtaataaataaatgaacaaagcctacaaaaagtttgggactatgttaagcattcaaacctaagaataattggtgtttccgtggaagaagagaaatcaaaaagtttggaaaacatacctgagagaacaatcaaagacaacatccccagccttgctagagatctagacatccaaatacaaaacactcaaagaacacctgggaaattcatcgcaaaaagatcattgcctaggcacatagtcattaggttatctgaagtcaagacaaaggaaagaatcttaacagcagtgaggcaaaagcatcacgtaacctataaagaaaaacctatcagattaacagcagatttctcagcagaaatcctgcaagccagaagagattgggggtcctatttttagcctccttaaacaaaacaattatcagccgagaattttgtatccactgaaataagctttataaatgaaggaaagatacagtcttttccagtcaaacaaaagctgtgagaattcgccactaccaagccagcactacaagaaccgctaaaaggagtgataagacttcaaaataaaccaaaatagaacctccttaaagcataaatctcacaggacttatataacaataacacaatgaaacaaacaaggtattcaggcaacaaatagcatgatgaataggataataatacctcacatctcagtactaatgttgaaaatgaactaatatagggactttagcactccactgacagcactagacaggtcattaagatacaaagtcaacaaagaaacaatggacttagactataccctacagcaaatggatttaatagatatttacagaacattctacccaacaactgcaggatatacattctgttcatcagcatatggaacattctacaagataaaccatatgataggccacaaataagtctcagtaaatttaagaaaatcaaaattatataaagtactctctcagaccacagtggaataaaactagaaatcaactccaaaaggaaccttcaaaaccatgcaaatacatggaaattaaataaactgttcctgattgatcagcagtcaacaataaagtgaagatggatattaaaaacgttttgaactgaataatagtgacacaacctatctaaccctctgggatacggcaaaagtggtgctaagaggaatgttcataggattcaatgcctatatcaaaaagtctaaaagggcacaaatagacaatctaaggtcacacctcatggaaccagagaaacaagaaccatacaaactcaaacagagcagaagaaaataaataatgaatataagatcagaactaaatgaaactgaaacaaaaaaactacaaaagataatgaaacaaaaagctagttatttgaaaagagaaataaaattgataggctgttagtgagattaaccaagaaaagaagagagaagtttgaagtatgctcaattagagatgaaatgggagatattactattgataccacagaaatacaaaagattattcaagtctactacgaacacctttatgcacataaactagaaaacctagaggagatggttaaattcctggaaagaaacaactctcctagaatataccaggaagataaagaaactctgaacaaaccaataacaagcagcgagattgaaatggtaataaaaaaaattcccagctaaaaaaagtgcggaatcagatggattcacagctgaattccttcagacattcaaagaagaattcaaacgaattctactgatactattccacaaagtaaagaaagacggaatcctccctaaatcattctataaagccagtatcaccctaataccaaaaccagagaaggacatcacaactacaacaagaacaaaaaaactgcagaccaatatccctgttgagcacaaggacaaaatactagctaatgaaatgcaacatcatattaaaaagataatccactatgatcaagtgggtttataccagggatgcagggatggtttaatatctgcaagtcaataaatgtgatacccaacataaacagaattaaaaacgaaagtcacatgattatatcaatagatgcagacaaagcatttgataaaatacagcatcctttatgaataaaaccttcaacaaaagtggaatagaagggacataccttaaggtaataaaaaccatctatgacatacccacagccaacattatactgcatgggaagaagctgaatgcattccttctgagaaccagaacacgactagcatgcccactttcaccacttctattcaacacagtacttgaagttctagctagagcaatcagaccagaaagagataaaagacatccaatttggtaaagaggaagtcaaactgtcactgtctgctgatatgatcgtatacctagaaaaccctaaagacttatctaaaaagctcctagaactgatgaatgactcagcaaagtttcaggatacaaaattaatgtacacaaatcagtagctttgctatacaccagcagcgaccaagctaagaatcaaattaagaaccacttttacaataacagcataaaaaataaaatacttcaaaaaatacctaaccaagaagatgaaagacctctgcaaggaaaactacaaaacactactgaaagaaatcacagacgatacaaacaaatggaaacacattccatgctcatctcatgggtagaatcgaaatcatgaaaatgaccatactgccaaaagcaacctacaaattaaatgcaatgctcattaaaataccaccatcattcttcacagaactagaaaaaacaatctgaaaaatttatacggaactaaaacagaggccatatagctaaagccagactaagcaaaaagaataaatctgcaggtatcacattacctgacttcacactatactataaagccatagtcaccaaaacagcatggtacaggtataaaaataggcacatagaccaatggaacagaatatataaccctgaaataaagccaaatatttacagccaactgatctttgacaaagcaaacaaaaacataaagtggggaaaggacaaactattctacaaatgatgctgggataattggcaagccacatgtagaagaatgaagctggatcctcatctctcaccttatataaaaatcaactcaagatgcatcaaagtcttaaatgtaagacctgaaaccataaagattctagaatataacatcagaaaaaccattgcagacattggctttgccaaagagttcatgactaagaactcaaaagcaaatgccacaaaaacaaagatattgtaaatagatgggagttaattaaccaaaaagcttttgctcaacaagataaataattagcagagttaacagacaacccagtaattgggggtaaattttcacaatttatatatccaacaaaggactaatatgcagaatctacaaagaactcaaacaaatcagtgagaaacaaacaaaaaaacaaacaaaatcttagcaaaatgtgggctaaggacatgaaaagacaatcctcaaaaaaagatatacaaatggccagcaaacatatagaacaatgcgtaacatcactaattatcaggaaaatacaaatcaaaaccacgatgtgctaccatcttactgctgcaagaatggccaaaataaaataaaaaataatagatcttggcgtggatgtggtgaaaaggaaacacttttacactgttggtgggaatgtaaactaatacgaccactatggaaaacaatgtggagattccttaaagaattaaaagtagatctaccatttgatcacgcaattccattactaggtatctacccagaggaaaataagtcattataacaaaaagatacttgcacgcacatgtttatagcagcagaatctgcaattgcaaaaaatggaatgaacccaaatgtccatcaatcaatgagtggataaagaaaatatatgtgtgtgtgtgtgtgtgtgtgtgtgtgtgtgtgtgtataccatagaatactacacagccataaaaaggaatgaaataatggtatttgcagcaacctggatggtattggagactattattctaagtgaagtaactcaggaatggaaagccaaacatcgtatgttctcattcatatgtgggaacagagctatgaggacacaaaggcataagaatgatacaatagactttggggacttgggagaaatggtgggagggtcgtgaggagtaaaagagtacacattgggtacattgtacactgcttgggtgatgggtgcaccaaaatctcagaaatcaccattagagtacttattcatataaccaaacaccacctgttccccaaacacctattgaaataaaaaaaaaatcaatttataaaacaaacagagaaaagggaagaaaaaagaaaacaaccttcattcacatttaactgaaattggtggctgaacaacgcactattccacctaggcttttacacatgtaagaaagggaacaaaagatttttaaaaagtgtccaggcctggtggctcatgcctgtaatcccagcactttgggaggctgaggagaaggtagatcacggggtcaggagatagagaccatcctggctaacatgctgataccccatctctactaaaaatacaaaaaattagctgggcatggtggcacacacctgtagtctcagctactcgggaggctgaggcaggagaatcacttgaacctgggaggccagtgagctgagatcgcgccactgcactccagcctgtgcgacagagcgagactctgtctcaaaaaaaaaaaaaaaaaaaaaggaaaaaagaaaaacttaaacaataaaaattgacattacttgcaagacccaactattttctatgatttcctttattctagcaagagttttgtatgtgttttgttttgtttgttttgttttcaagattggacgccttttcaaagaccttaacctatgtgtttgtgcataatgtgtatagcataggttcttttctgaaagtgtgtccaatcttaaaacacacacacacacacatacacacatccatgtgcatttgtaataactgaaactaaaagaagctgattactaagaatataatgaaccttattgtttactcttcatcaaacatataatcatcaaatatccatttaaattataaataaaaataagtgatttcataagataagtttgatgccagaaacgaggattgaactggtttgatccatgaaatgctgatacatgcaaaatagaactccatttgtaatttctttaaagtaatactccattcttttttattagaccattgatgagttcgctcctttctctagatcagaactatttagattgtttttttacaaattcagtatgaaggaatttgttttttaataggtgtgaatagcatcgatgtaatgatgtgtcattgagccccacatttctgtcactagagtggtaaaatgacacagaggatgaaccaaaagtcacctgtagatgacaatgggtgaaagaaaacacatttaatttacatagaaacatacagaatgtcaaaagagttaaaattcatgaataaaatttcattaaaaatgcattctaaaatattagttaaatatacactacttaagaatgatttaaaactagcattaaatgtattaaaatggatatattttgcaggaaaaggatgcctgtgttttcagtgttttatctgaattatttaatggtttacaaaactttctgtgaatgaagggaaagcagttttttatctgagtattctcagtgttatctgagcattctcattgcctacataacttattctgaatgaaggcaggcaaaatagagagaaaagactgagtatctataccatataatactttaaatagaaaacattagccctttgttacatatctataggctgaataagaactcaaacacagctcttccaactcaacacacaatgctctctttgaggtctgaaggttataaggctatactcataacagattctcagtctcacaattaaactaaaatctaggcttgaagagattaacactatttagcatgccaggctgggttgtaacacagtagccatatatttattttatttcattttgattttagacctgcagtgtattgccagaccccaggtgagtttgaaatattgcaatggttatttcagaatactttgtgtggctttactgtcatttatgttaaaggtaaacaggattctctgctcgatcattgacatcaaaggcaaaaacgaatgataaattattttccctctattcttgcattttgagacaatttttgttgaagttcaaatttacaagcgtttcgggaggatgttttcttctggggaaacaacattcacagcagtccagactgagggtacacagagagcaaaaacagctctagctgctgagtgtcctgcttatactctcacatttgcccatctactaatctctattactgttttatcttatttttacagatcctacatatctaggaggttccttttaaaatgcaaataaaatatctaaatgggagtgtcactgacttcattatcattcatcaacaccataacagggattattttatcacattagtttgcttcagagagttgagctgcaagaaaatgggactgaattcacttatgttttgaaaatgaaagtgctggataacaaggtagcagttttcaacaaatttaaatataaaaacctttattaatataataaaatgtctaatgtctattaaattatatagtggcaaaagtcttagagaattcagggacatgttaatattatcaattataaattgtactagagaaagctactccaaatgggtggaaatcaaagaagctgatcattttccaaggaatgaccttgcatgcttttacctaaaggaactgtttaaatttttagatcagaaaaataagtgaaaaaaaacagaagaatggtctaaaatatatatacttatttaatgttactgtcagaaaatataggcttgtaagagagcttggatttcaattttagaaagaaacttcggtttctttggagacaatgtttatattaattcaatagtgtttctgtacatatatatctgatattgactgccattgtctcttctataactttctttgagtcctaggtttatatttaatcttatgatatcttcatgtatatctcctataaatatttcaaacttaaatttttaaaagcataagacatcatttcccctctccagttgcaaaactcttccttctttgtaaatgaatgaataatacagcaaccactagaggatgcaggctagaatcttggaagtcttactttatttcttctcttatctcattatgtccttactttcatgtttacttttgaaactatccagttctctctttttctgtaaaaaatccagagtctcctatcatccagtcaaaatttctgctgtagttgtgtaaccagtctctttaatccaaggtatattttcagtgctatattagcagtcatactgaaaaaataaactaaccattgttatttgggataatttattatgcagtaataaataactaatacgctaaattgagaactcctggaaagagagaaaaacatataaaagattctttttttttacactaaatccctaggctccatctcactttgatggtattagacacaatagaagctccatttttttctgatgtatgtagaattaaaataaataaaagcaaaacatcaataattaaaacaactataaaaatgtgtagctcaaactagagggaagctggaatggcttgaggaaggaaaatgataaatgaaatcaaagaattgattcatgtgaaataaaagaaaaatgctttttgcaaacaatactgctgactaaagggtatacatcttatgaaatgaaataatttatttttttgctcactgaacactatgatggagttatagatgcagaagtaattttgtagttgactttgaaaattgttttgaaaagtagaagaaacgagttagatgtttattgaggcaattggaggaaaaattgtgctgaagttaaggaggatagggaggaggagacaggaagagaaagaaaatatcccagagaagtgtaatggtggtggcattggatggcttgttggtgtcacttttttcatattttgaaattttttaatgtatgttcaaatcacagaaaggactgattccacttctgtgtagttagtgtaaatatagagagcacctactcagtgaaaagaaaattaataagcttgaataatttagaagaagatggaactcttagctagaggtcactaaaaaaagagaacatcaggaatgtaaagacatactagggagaatattgaactttcccctaaaatacagtaaaattttgagctgatattgtctagatctttaaggcaggaagggtgcagatgaaatatcagttatctaatatcaacatgagcttagtttaatgaatcatgagattgtacttatgttaaataactacattttgaatcagtgataactatccaggatataagaaatcatttattttccataacaggactgtaatgcagaggtttggctacacagatgatggagaagccaaatatctcccagtaggaagtcactaccaatactaattaggagggataaacgaagaggaggttcaacctaagccagaagatagtgttaacaggcagaagctacaatcatgtggacatgtcctgaaaaagtgggagccacaaaggatacacagattctggatactacctaattcagagagaaagggcgagggagagagaaataccctgtgttttctatttcttcacttaatttttatctgtgcctacctttgtccaaaaccacccagaagcagatgacagggttgcccagaaaatacaagattatcagtcctgttacacagagcacagcaagaaaagaacaaatcattggtcaaacacacccaggatgggcatagtttatatgtaagggggaccaaattatcaaataacttgataaaaagagtgaatctagagatataaagtaacaatgaagataaaattgccaccaaacaagtttgcctagcacaagctttgatatacactgatttcagagccccattaggatactggtgccactgagacaattaaatttcagaacccatttaattttatacaggaacccacttcagctcagatatcatatcattgccgtattcacaacatttaaattgatttgcgggcaatccaacttttaattctgactcatgtaagtcttctagatttacagcaacaccatgttgaactgcactggtttgtcatctctcccattccaggatctgtttatattcagcactgtatctcaaggacaggcaaatagagtcagatttttgacatagccgaagagtggtgactttagagaaccctatttcctcttataagagctttttaggaaataaccagttactagcaggtttaatgcattggcaaagtccaagtgtcctctacatctcacatcctttgtgtcatctataaggacataggaaggcaacttccagaagcaaaaatatgtctgtatcttctgccctcactttttaggtcaacacagccaccacaacccgagctgccattttcatttcctgccatggatatctgacagtccttcatactgaagaaaagtaagtttcattgatataaaaagttataggattattagaagtatttatacttatttttgtttttagcatgcccactaaatacttcagagttagtcataaattgacaagacaacccctcggctttactcatttcattatttattagttctcaaaacaattttctcaaagtgtgaaagtttcttttaaaaaaggtagcatgaaactatttcagccagaaatagcctatgaattcatagtatatgtgtcactttcctttgcctttctgtaatagttactcacagacctgagcttctgtaattggcttattttattacttggaataaataagattgtatacaagaaatcctgtaggagaggaaaacacaactcttgggcgtggatattattctttgacaacccaaagatttttccaaatggttaataaatggaccattatcttatttactcttgaggaaacttcttttccagcatctgaggtaatgacttcccagtttttgacctgccactgtaaggtttaaatttggttttcctcaaaactgatagatatcagaaattacatctaaagtgttaaagattctgagctacatagtactgggtgtcaaaaggttacagagacatccctataccagctgagagtccattaaaaaggtcactcacttctgttctcacaagtattgttcactgaattgagtcaagaaacgctcaataaaagggaaaaagaactaaaattgttcctgagaattacctgacaaaagtgagatcaccgaaagaaatgatttaggaccataccacggagagacacaaagtggtaccagagaccagctcattaagtttaccatatacaactatggtaatttgtttttaaaagatattctaaaacaggtaagtcaaagtttcacatatggaaatatgtccaaattaaaatgtgcttgtcttcctgaagagtctgggtcattcattaaaaaaaaaaaaaaaaaaaaaaatgtttgtccaagattttagagcaggaataaaatatcttcatgagaattacttttctattcataacaggaatttgtagtaactcaatgcatttttataattaaaatgtattattaattttgtgtaatacaaatgaaattggatttagagataagtttctggatgacattgaaaactcagtattagaaaaattccaaataatttatagagaattctcaataatttatttaaatactctgccatcaagtagatacagcataactgctcaccacttaagtgtgagatgcatatagtgacttccttctaaagaatatagtatgaaaatgaggggaaaaataacatctgtacaatcaagatacctggaaaatactgctttagtgagttaatcaaggttaacatcattaataagttgttgtttatagtatatatagtatatataccaattataaatatatgttgatagtgtatccccttgaaatggtacaatgaaaatggcactttacctctttattttccttgaaatagataaaccatatctagccatgagaaaaacccagacttaaggatttttcataaaatatctcatcatgttcctcaacacttttaaaataggcctactttgttttattgtgctttgctgatgctgtgtgtttttttatttgtttgtttgttttttaacaaattgaagggttgtgttaactgtgtccagcaagatgtgactgaattgctgcaatcttatgatcaaatttggagagatgagagttgctttttatggatgagcaaataacatggtttcttgagatgtaatctattcctggcgaagatgctgtgaacaatgttgaaataacagggatttagcatattacataaagttagttgagaaagcagtggcagggtttgagaggattgactctaattttgaaagaagtacattggtgtcatttttccaacaccatgtgctcacttcgtgtctctgcgtcacattttcgtaattctcaccatatttcagacgttttcattattatatctgttaaggtgattagtgacctttggtgttaccattgtaattgttttggggcaccacaaaccatgcccatataagatcacaaacctaatcaacaaatgtatgtattctgactgctccacccactggcgattccctctttcctccccgtctcctcagtctctctattctttgagaaacaacaatattgaaattatgccaattagaaactctacaatagcctttaaatcttcaagtgaaaggaagagtagcacatctctcatttaaaatcaaaagctagaaatgattatgcttagtgaggaaggcaggctgaaagctgagataggttgaaagccaggcctcttgcaccaaacagttaaccaagttatgaatgcaaagcggaagttcgtgagggaaagtgctatttcagtgaacgtatgaatgataaaaacaggcttatggctgtgtgatctggataaaagataaaaccagctaaaacatttgcccaagccaaagtttaatctgtagcaaggttctaactctcttcaattacgtgaagacagagagatgaggaagttacagaagaaaagtttgaaagtaactgggaagtcattacctcagatgctggaaaagaagtttgaaactagcagatgtttgttcatgaggtttacagaaaggagtcattcctataatataaaactgcaaagtagagcagcaagtgctaatgtagaagctgcagcaagttattcagaagatctagctaagataattgatgaagatgattaagatgaacaatggattttcaatggaaacaaaacagtttaatatgagaagaatatccaaataggaatttcatagctagagaacagaagtcaatgcctggtttcacagcttcaaaggacaggctgactttcttgttagaggctaatgtagctggtgattttaaagttgaaactgaatctcatttactattttgaacattttaggccccttaagaattatgttcaatctactctgcctgtcctctagaaatggaggaacaaagcctcaatgatagcacatctgtttacagcatgatttactgactatgttaagcccactcttgagacatactgctcaggaaaagatttgtttcaaaatattactatttatagataatgcacctggtcactcaagggttctaacagaggtatacaatggagaagcatgttgctttcatgcctgctaacaaaatatccttctgtagcccatggattgaggagtgatttttactttcaaattttattgtttaagaaataaatttcataaggctacagatgccgtagatcgtgatttctctgagggatcttccggaaaagattcaccattctaaattccattaagaacattagtgtttcatggtaggaagtcaacatatcaacaatactagaagtttggaaaaagttgattccaaatctcatagatgacattgaggacccaagatttgaatggagggagtaactgcagatgtggtagaaatagcaagagaactagaagtgggagaggagctgaaagatgtgactgaattgctgtaatctcatgatcaaacttgaagagatgagaattgctttttatggatgagcaaataacgtggtttcttgagatgtaatctattcctggtgaagatgctgtgaacagcgttgaaataacagggatttagcatattacataaagttagttgagaaagcagtggcagggtttgagaggattgactctaattttgaaagaagttctactgtgggtaaaatgttatcaaatagcattgcgtgctacagaaaaatctttcatgaaaggaagttaattgatgtatcaaactttattgttgtcttattttaagaaattgtcaaagatatcccaaccttccttcatcagtcagcaaaagccaatattgaggcaagatcctccaccagcacaaacatcataacttgctggagagtcagatgatcactggaattttttagcaagaaagtatttttaatttaagatatgcacattgttttttaggcataatgttattgcacacttaatagattacagtatagtgtaagcataagctttatatgtgctggtaaccaaatagcttgtgggatttactttattgaggttgcctggaactgaactcacaatatctatgaggtatgcctgtattatcaaaagcaaggaaagtctgagaaactgtcacagtctatatgagctcaaggagataagaccaccaaatgtaaaataatgtcctatataggaccctataacagaaaaatgaaatgacataaaaactataaaaatctgaaaactgtatggacttttgttaatcataatgtatcaatatcagttcattagttgcaacagatgtatcatggggaaactaggtgtgaaatttaagagaagactaatattcctgcaactcttccataaacttaaaactattataaaatgaaaagtttatttctttaaaaacttagattagtaaaatatagttaaaatattaataaactccctgaaaactatgaataatgataactatgactaacatgattgtattttgagtgatcaatctactcagatattcagtatatttcaaatttaatgtttgcttaatggaaacatacttaaaagtaaaacattgcccagaagtaaatgaggaaagttaaattttaaattatgatacacatgtaacatatatggaattgaactgcagcctttcctaactttatatggagcatctccacctccctacttgccaattccaacactaacccaactctaagcacactggcaaatcatattgtgtttacagatattgtcttgggatggggataaaggaaagaatacattgtatctcatatagcaagcattataaaaatgatctttaaaccttttttttcttttttttaatgaaaggtctagaaggtttgtttagctttattctcacactctccagaatctttttctttttctctttttgaagaccacatgggtgcagctttattccactcttagtttatctagatcctattgtttttgtagttaatttaaatctctcttgatttatttaatttatagccttacatatcaatatcctggaagaacttgaaaatgttcctttagatttttatttttaagaaggaaagataaaagtattgcagataacttttttaacttcctttattatttgctctgccacaaacaacctatataatattcagtatttttttccaggattaacaaaaggaaactttgttttcaacaatttttatggtgcaggagtactatctggcaatacaagtttatttgaaacagaactgcatgacactcacatattaagcactttatgaaggaaaaccgtaagaaaatatcctagaaagtaaaatgttggaatataaaataaggaatcctatgctaaatctctgcctttggtgatttcaatgattgagaccaaactcagatttccatcaagattcgtaaaacttatcctgccattgttgaattcactactggagtatatatactgttcctggtcaatttttagaaacacctgagctgataaaagttaaaagaatcacgaggagaactggaaatactgacttataggagataataaatatccttagattcatatactatgaaaaaatgttttgctgtcttcttagctgctatgctttctatttcttttttttgacacacaaacattagaattttcaaacaaatttactaattttatgaacttactattttatttatttattattctatgtacagtattccattactatacaatgaagagtatattttctttcatttttaggtggttaataaaataattcacacaaggttatggctaatcaaattattgtagtcaagaagtcagaattgcagataacagctcttggaagtccacccctaagtatggagggtgttcatgagtttaagagaaattttcgtgaactgactagtcacataaactggtttctactatagttggggacaggactggctgtataaatgacagggtatagtgcaaaatgaagataaggggctgcttattaaaaatttattcagaattttaaaatggtgtcaaaagatcatgaaaccaacagcaagaaccttttgagcattgagtcctgtgcaaatgtaaaaaatcatgaagctggtcctgcataggggtagtgagaattagggaataaatactattttccttttggtaacttagtgatcccctgttttaagtatgaatccataatcttaaactattttctcttctttggtataccattgcatgtactatctctccttttaagcttttctgcttttctcttgtatttatttaatttataaaccttcaaataaatgaaatatgatgaggggacagttcctcatgtagcacttagtcataggtaaggagtggaaaagcgcttcatggcactttattttaatgtttaatttatataactatacgcctttttgaaacctgtaaggacaaacaattgaacatctaaagacagatatccatatgtactgtaatttcctgaattctacatttttgggaaaaaagatgttcttctatggtaagggaaatatatgtatactcacacaaacacactcacacgcaattatatatttttagtaccctattacgtttgaatataacatgaaataacagacatatgcaatgcttacggaaaattgatatattaactttctgatactgtgatcaccttaatttcttgataattcattttatttgcatgtgaagctttgtaaacttatattttgaaattgaaagagtcaattagaaagcacctcaggactcatagtgtccttcttttattgctttgtaacacactgcttttatgtaattgctttaatactctactatgtagcactagtgtgacaatgattattatgataatgatgataataaaagcgatatttaataatataaattgtaccttgaaataagctgtaagtacagtctacagagcttaaatgctaaattctcaaaataactcggtctataagtggtagtcttttatttgtttttctgcagctcctaaacactttccaaaatgtattcagaaagtgattataatggaaagatggtcttccttaccaaaggaatgtttagatcctttctgagacctagggactatatctcacctccagagaaccataggtttatataaccaccatatatgagacggtaaaatattaattacaacaataagcatcttttgagaactttttccaggctatatcagaagcaaaaaaggttttgtttggtgtttgttcttgctttgttctatgccccttccatgtagtgaccattattatacatatcttgagggaactgaggcttaaaaagattatataaatttaaacagagtaaatttgcacaaggctatgctacaatgttaaaatactttcacagaactttataacttacaaagtattttcctatttagctcaataataaacacataaggtcacttaggctccaataataatacaattttgaatgaatgagatattcttgccttatacttccatggaagagaaaggaattgcattatacactatttccatgatttagttacagacatattgctatgtgaacagaaaggaggataaggcaaattctacctggaactttcggatgatttcatgagtggtcatttgtaccacttctcccaagcagttttagaattatatgagcaaatgtatgaagatggtaaaaatctgtgcctgcacaaggaacaatacacagtctggtttggttagagaatagaatacaaaatggcagctattcttggaaaatgcatattaggctgatctataaaactttgaattcctacttatatgtacaggatctttctgtgtcagttttgaatggaggcataatgaaaggatggagaggcaagaaggaggttacttaaaaggctacagctaaggcaaagttaataatcaccagagattagacagtagggaagaaactggatgcaaattcaccacactcattttactttttttctggtcacaccatatttctagacttcctttaagtaaaggttaaggataaattaaggttaaggataaaaaaaaaggcaaaagtaaataaattatttgcaacctatcatacatatctaacaacagaataaaaagataaaaggtactgattctgaacattcccaaaatttaccacttaatttctggaagaggtttatcttctactcaaatttagtgaagagagaaggtcactgtggcttaatgaaatggctcatctccaagctaatgtccaatctcatatcagccaaagtatgatcaccaggttacattaaggatgagcttgatatatattttttcactcaaacacccatcagctttgcaatgcaatattctctctcaaaggcaagggagacatcgatgttaaataaaaaacaaaagaatttagaacaatctattttgcattgttacatacttatacaattgcaattaatatttgctttattttaatctaccataaaattgtctgtaaatggaatttctcctcaataaatgagtgctccacatcttttgccccatctttcagctcaataatccatgctcagggtggatgtggaaaccccgtattgaagaaggcagcatgtcaagaaccacagtgttgaaatgactacatgctctgttataaacactaaaattttaaggtttatctttaatatctgctagcattatctggaatgctaaacagtactatagagaaaaaataaaagggaaggtggaagaaaaataacaagttagtcaaggttgttataaaatgtgacgatttagataaacttaacaaaattttacctctggtaaactaggatgttggcactataatacccaaaatgggatacataagaaaaaatgaatctactctgaaatgtaatgatgatcaggctaagcgtatgttagggtttagagggagcgcccctaaaatataagaaaaatatttgaaaataatactttgaaactatttttgacagctcaaagaagcagcagcttctttcttgaagcagcaaagtaatcatacgggggtaatcacaatgtttcttatgctcttatatgcactctacagtttggcattgtttatcaatttcattctttccagcgattagagcctctaaaaattcatgctagtttagaagtatgtctgtgtttaggtatctagagaacaggaagagagttcgatatgttgctcagcagagaaaccaattctaagagtatatggcacaggagtcaaacccttagaaagattgttagagccatgaattggtataggaccacaggagacaccatagaaaaataagagtagagtgtcatcaggctatagtcccatttacaaaaaggaaggctaattagcaaaactaaatatagtcaagagataggagaagaaacttaaagaaaggaattatcactagcaaatataatgagaatataccaacttggacttatccttactggaggcatcagggaaaccaaatgggttcattggccaaagtgggcagaaagatagctttgaaatgcatctgtcatggtttggatcatggtacaaaagcaagttaaacttatgtagatacatcattagtagataaaatctttatttatttatttatttattttttgagacggagtctcgctctcttgcccaggctggagtgcagtggcacgatctcagctcactgcaagctccgcctcccgggttcaggccatttcctgcctcagcctccctagtagctgggactacgggcgcccgccaccacgcccagctaattttttgttttttcttttcttttttttttttttttttttttgagaccggagtcttgctctgtcatccaggctggagtgtagtggcgcaatctcggatcactgcaagctccgcctcacgggttcaggccattctcctgcctcagtccccagaatagctgggactacaggtgcggccaccacgcccggctaattttttgtatttttagtggagacggggtttcaccgtgttagccgtgatggtctccatctcctgacctcgtgatccgcctgcctcggcctcccaaagtgccgggattacaggcatgagccaccgcgcccggcccataaatttttatatatttcaaccaaaattagaaaaacagaataataatagtgaaagaaccagaaagtgacaatcttcaccaaacgttcagtctcaaatggtatgggcaaaagcacaccatgcacacagaagaaagggcagactgagatgaatgtgggtcattagggttcaagaagtgttatggaaatgaagggagtaaagaaaagaagaacatcaatccaggatacaaaacccatggataacttcagacaatgcatttttacagctgtgaatattttaatatgatagctaagtaaagcaaacatattaaagaaagttgaagagaggagttacaaaagaagtattgtctagaggagtcagagggaaatataatttgatagagaaaagaagacaatggcattaataagcacttagtatatatgagaaagttgctagagaggatggtgggcagaggagaaggattctctgggttcaatatgaaatttctccacttataaattatttcaccttagggaagttattcatttttaatatgctcacaaataaacaggataataatttgttttcatattatttctttcagagggagtaaacagagatccttttaataattatgatgtgacaacaggtgcaaaacttagacaaactaaggtatctgatcaccatatttactaggcaaaatattgaggttaaaagaatttgtgctttgttttttcttttcagttttcaacgttctcatcccagtagataacaaaaggtctgtgacaagatgggacatagcaattctgtctctgtgatctgcccatcaggaaaagagctcttaataatccaggctaaccttttctgcagttaaatgtacccagtttcctccttcagtggtatgatcttagacatcagctttctttgagggaaatcttcatagagacattgagagaaatctttacaatctaaaattacataatggaataggtctgtggttatagttcagttttaactagggacatacaagtcataatgtcttaacttcaaatatcgaaaatccataagaatttaaggtatgagaactgaaggacagaaaaggcagtcttatttgtgctatgagatgttcttaaatccctcacataattgcaccaggaagtatactttctttcttcatttatctcttaaagctcggtcttaagacgaaggggctaaaggcctgagtttcaatttatatttgtttcataatagcagtgacccctcaagaaatggccactaaactgtgggaaacgatgaattcctacacagtaaaatagattattttcttaaaaatggcacaaggttttatgagaattacagcagaaacattgcttagcatcatgcatggcatgtactaaatattcagtctatgctacttaggtatccttgatgttataatatgaaattgtggatatttgtaaatatgcagtctcctaatacatagttgtaaaaatgtgtgaaggtgtccagtgagcaattaatagattcttaaataatattccattcttacccttcatgatttgtatggaagatttagagaatgaaacaaaactctgggatctgtaccttttaactgaaacaaccaccagaactaaatttacataaccatgataaataaatctctaaataagataagtatggataaactttgtaaactttctctttttaagatacaaacaacaataatagtgtgggttatttcttcataaatcatatacactcccagttatttgtgtcaaacttctctcttgtgcctgatggtttccaattcaaaacatggtaatatttttccagtattcaaaggaagttctgatttgtcagtacatagaacttaccatctccaggcatacgtattgatggaatgtaagttaacaattcaaatctttttttttttttacattgggtggtaatttggatttatgtttctttaaaactaagtcattggtgtcatgttcatttccctatagctaagattccatcatactgaaccagaaagaaatagtatgtgtgtacaaaaatgtaagaaatcagtactccaagctatataataggttgtcaaacattattctcataaaatatctatagacacattggccaatatttacttattttttatagtaatgtagaagcaatagtagttaaaaacagggactttggagccagaataatctgtattggctcccatctccatttcttatttgctttgttctctaacaagtctcaaaatttcttgtctcagttttctcagttttaaaatggggataattatacatatgctttacatagcatatttaaattactaattactgtagtaattaaatgttagcataactaaagtttatacctgtcgggtagtaaatattatgtggttgtactaaatagtaagctgtggttgtcaattctaatattcttaatagtacacacttcattgtgttctacagatattgattaaatataatttttgagaaatttaaattttgacttttctctaacatattaaaatattctaaaatatagaattgctgggttcatgagactatagaaaccatatgtgaaaataaagtaatatcagcatcctatagacatcttctagaatcatagaataaaaaaggttctttatctgttatttgtatttcattttattaagctaagaaagattaaggataaatactcttgaaaaatacataaaaataataaaaattaaaaataaataaaaaatacataaaaaatataaaaaatagaaacgtaaatctacattgccacccaatgtaaaaaaaaaaaagatttgaattgttaacttaaattccatcaatacatatgcctggagatggtaagttctaggtactaacaaatcagaacttcctttgaagagatttattaagagatttgatgaaagtgattttaaaaatgcaaacacagaattaatctcttgctctgactactgccctatctcctaatttgttgttctacttctgttcttgctcttacttattctatttttcccacagtagccagagcaatttttgtaaaacatgaaactgattatgtgactgttctgctaaaactcttcaaattcttccactgtgcttaaaatacaactaaattcctcacctttgtttacaaaactcatgtaatctgttccttgcctaatgctctcacttaaattcataccattctctttctcacttatttggcttcacccataactttctatttctggaacacatttatgttcatttccagcaaagacactttgtaattgccatttcctctgactggtaagcattggatctagattttagcaccattaccatattcttatgattcagatcttaactcagtgacgcctcttttcagaggactttcccaactaccaaatcaattgttgtttaaattccattcttatcacgaatacccttattaattgtcagtcacattactcttgtagcatattaacatgattgttctcagaaattatctgttcattcatctacctcttgattgcaagattgcaagctccttgagaccaaagattttgctggcattttccactggtacatttttcccacccagaacaatatttcctaaattacagtatcacaatacatatttgtgtaagcaatgaataaaaggacataaatcaaaagagaagcttgttgatatgctaatatgaagatgctgatgttcaaacagaattttatcagtaaatttggaataaaaagtgttggaaaagatattcaatggtaatggggtgagtggttgatatgtattgtacaacagcaactgagaaacattaagtgtgaatagaaatatcagcaaatgcaccattgaagtagtatcagtagtacacaaagccaattcatcatgaaatagtttacactctaactcttccataagtttcatatttggctctttctttagatcccctttgcccactttattttgggctatcatatttcttcctgttttctaattaggtgttgtctttatactgtgaatcttagtcttacttgaatcaatgattagtagaaatcactgttgtgactaacatgcttcttcacatatgtgtttaaaagtaccctaaaatcaattcatttaaagtgaaagcctgactgttttttaaaatatctttcaatactacttcattatcacattaaataggcaataaccttgcacctcattattttatattgggtcttggctaactgtggctcttggactaaatccagctggccagctgtttttgtaaacatgattttattgaatcacagccacacctatttatttattgtctatgactgctttcactctacaatgacaggatcattgcaacagagactgtacagccaacaaaacaaaaaaatatgtattatctgccctttatcagaaagcttccttgtccctactttaaaccactgttttacagagattaaaaactatataaaattcaaatcattttcttccatcagctttactgagtcatatctgtctctctccctttccatacaatataaagattacctttcaagatctcttattagcctttaaacattgaagacattggcaaacagacactactttgttttcactagtttcttaataaaactgttaattgacaagttaccttatttagcaggaagccaataaaccacagtgtaaatcagtagattacgctgctttaagcttttgaaaaaatgattagtctcactaaagggttgggcaattactgccactgctaactaattttgtacctggaaataaagatctgcaatttgttgcccatagctatagcacacagcctgttgacttagtacctatacagttataaactatggattctaagaaaatttaaatgtatgatgtttatttaagtatatatggttatgatgttatctaaagtacatttattatgaatttcttggtatataatcattcatgcagataggaggatctctcattttgcaataaaacttttaattttgacccacacaaggtaaagagatgctcttgaggtacctgcttctaaactacaggcgatgaatgtgtgtgtggactcattggtgaatcctcatatataaacaaagtagatgatatattcatgctaaaaggaatctgacttggagcgaaggcccttttctagaggcataagatttagtcatacaaaaacacttaaataattttaaaggcatcagactctctgtacagtagggattataaaagactgaaatttcccttttgtaatagggtttctggcctctctggccctccagaaatattaggtatagcttaaaatcagagaaaaataataccaattgccagagaatgctttgtccttcatgatgtcaatagctgtccctcactggttgctctgatctcttctttctgtcagcttctcttcacctatacacagacaactatgatttgcaggccagaaatgtaagagctatgcatattggtgccacattaaatccatggtcatcaccattaaatgagtccttaatatagcaagaccaccttgtttcattttttctgtaaactcctgtttccctcattactatcattgtgtaaaaactgtgtgtcaaatagagttattaacacccgcacagttggacatatgcgagttaactatggctttgtcacacaggaatggcatgatctggaaaaaatgggttaaactctccatctcttagttttttctcctgtaaaatgatgacaataatgtttataacatatacttgtgatagcattaatggtacatagcatatagttagtcctaataaaaatgatttattgtctccatcatgcctctctgactcctcctcctcctcattgtttttgaacatgtaacccatatgctactctttcacctgagaaattagaacaaatacaacaagattaaccctgcacctttctgtttctccttttatcatctttcaatggaggacttggcttctttctaagggccatttctctctgtcctctagtttagatgccttctaattgaatgctatttactgttcaactacttgttattttcttaacatttccttgtaatataaacactctctcattaaaagtcaattatggaaccaaagaacttctgttgcatatctccttttgcatggatggaccttttggtttcccttatctctttgggtttaggggtggtaagggattcccattgttgctaggcatgaggtatttcaacattctgttaaggtttcctcactctgttcacacttctgtaaatagttatttcattgaaatatcatattaaactctgtgtgtgctactgttctgtgccaggaccatgactgatacagatgcctatgatctttatggagtcagtagaagtgttagtctaagtttctgggttaatcatccaaactctattaatagcttattacatgccagatactgagaaatttgaacaattgataatgaatgctaacttaagactaataagatcaaacaatcagaccttatttcaagaaaaaagccctgctacttaccttaggaactaatttctcttcttttccaaaatatatgccatttcaaatgatcagtttaccctcgacactagaatattttctcttcatcattccatatttaaaaacatttatttaacataaaaagagcaagttaattacaatccttgtttccttggccacagttatagctatctcacagaggagaaaacacattttatatgaatggcacctatatttcttttcaccgagacacatttaacaacccatcttttaaagcacaaagaaaggagaaaaccttcagaaatatgtcttttcaaatgttgttaaacattgatttgtctgattattataacttgagatagtccttattgtagtaattgaatacttaaaatttaagaatttatgccatgttatatgttaattttatgcatccactttctatttctcctgttccagcctcccacatcctaggacatctgtgaagataacaaaattgcaaatgccagatggtagtatgatcattaaattaaaatcagttccactcttgtttcaatcatgaaacagaacgatcaaatttgtaaatgtttctattttggatattattttattttacatgaaaacaaagagatgtactttaaaaacattacattggtaaattacagtatttttttctctactaatcttattttgtaaggttctaaaatttggttgactaacacttgtgttctgcaaattagtttacctaaaaagaggaataaataataataaactttgaacaaaaaaaactaatataaaatactgttatatttcacataactaatggaaaaaaaattctgacaggctttcttgacacaaaaatattaggaataaattttgttccttgttgcagggtgaagtaaggaagatggttgaataagtaccaaaccctcctctgaaagggacaccaactcaacaatatgcaaaacattctcctttgtgagaaacccagagaccagccaagagactcctatagcccaagtgagtatcatgccagccacactgaagttgatgggaaaatttgtggcacccacttgccaaagccctgcccttagctcagaaatgtgcaatcagaaggaagatcctaactcctcacttctccctggggaggaaatagaagactggaacatatgtctaatgttcagatttggagggaactagctaagagactgatttcttccctatttgaatctaagtgctgacaggaaagggtgtcagataagaaaccagtggaaacagaggcagccctttgaactagcacacactcagttaccatcatctttctccccagctcagcataacagtttcacctgacttggcatactgacaggaatttgaatgctctagatgcttgaggatactgaaaacaaacataagagctccagaggacctacagtatagcagacagaagctgattcaacttgacagtttgtccctcagggggaaaagagaagaataaaaggtgtgtcaaatattctgactttcgggaggagctgcctgaaaaactggttgtttacttgctagtctcagagcactaaagggagctggcatactctaaatgcctgaggccaatgaggagaaaaagaaatgagtgacttacagtaacatcaaaggatcttcattagtggagacagacaccataagaaggaggaaatttcagcttctaaaaaaggaaaccagtaaaatctccctaattaggaatttacaaattcacagaaaacatttgagagacccgcaaaatatgtagctgggtcatttcaagaaaaactttccctgtttggagctggtccacaaatactgggagagggggctacttttcaaatgcatagatcccaacaaaaagtaacaaggcacatgaagaaactgttgtaaccaacagttgggcacatgagccaagcaaagtatcaaaaaactatctccagaaataagtcctaaagaaatggagatatatgaattactcaacaaaaaattcaaaattaaccattgtaaagatgctcaatgaatacagaaaataaatacataaaatgacaacatcaacaaagacagaaaattttcatgcgagtccatgtgaagagaccaccaaacaggctttgtgtggcaataaagctttttaatcacctgggtgcaggcgggctgagtccaaaaagagagtcagtgaagggagatggggtgtggccattttataggatttgggtgggtagtggaaaattacagtcaaagggggttgctctctggcagcaggggcaggggtcacaaggtgctcagtggggagcttctgagccaggagaaggaatttcacaaggtaatgtcatcagttaaggcaggaaccagccactttcacttcttttgtgattcttcagttgcttcaggctgtctggatgtatacgtgcaggtcacaggggatatgatggcttagctcggatcagaggcctgacattcctgtcttttatattaataagaaaaataaaacaaaatagtgttgaagtgttggagtggcgaaaattttgggaggtggtatggagagataatgggcgatgtttctcagggctgctgtcagtgggattggggcagcgtgggaacgtagagtgggagagattaagccgaaggaagattttgtggtaagaggcaatattgtggggttgttaaaagaagcatttgtcatatacaatgattggtgatggcctagatgtggttttgtatgaactgagaaactaaacagaagatacaagatctgaataagagaaagagaaaaacaggtatttaaggactaagaattgggaggacccaggacatacacttagagagtggccaagggggttcagcgtaagtttttgggctctatccttgtcagagttctcctttttaagttggaggctgagcttgatgaggcgtgtttttaaaagaccattagtccattctacgtttcctgaagattgaggacagtaaggtgcatgaaagttccactgaataccaagagcctgagaaactgcttgggtgatttgattaataaaggccggtctgttactggactgtatagaggtgggaagaccaaactgaggtattatgtcttacagaagggaagatataaccgcggtggccttttcagaccctgtgggaaaggcctctacccatacagtgaaagtgtctaactagaccaagaggcattttagtttcctgatatgagtaaagtcaatttgccagtcctgggcaggggcaaatccccaagcttgatgtgtagggaagggagggggtgcaaaactaataaaaataaacacacagaaattttgaaactaaagaataaaattatataattaaataattctctagaagaactcaaaagcaggcttaattgtgcagaagaaaaacagtgaacttttgaaatgacaagcaaaaagaaaaagaatgaagagtgaagaaagcctaaaagactgatgtgactccatcaagggaacaaatacacattatgagagttttagaaggggaagagttaaagaggtaaaactcttgttggaagaaataatggcagaaaacttcccaaattggggcaaggaaatgaacaaccacgttgaagaagtccagtggcataaactcaaagaagacaacaataagacacaatgtaatcacattgtcagaaataaaagacaaagagaggattttaaaagccagcacaatattgcagtgaggcgagatcacaccactgtattccagcctgagtgacagagcaagactccgtctcaaaaaaaaaaaaaaaaaaaaaaaaaaagcagcacaataaaagtgattcattatatacaagaaatcctccataaaactaacacaggattcctcagcagaaatattgaaggccagaaggactagaatgacatattcaaagtgctgaaataaataaaattgccaaccaagattactatatggaacaaatctgtccttcaaaaatgaaaaagaaataaagacatttccagattaacaaaagttgaggtagtttataattatacttgccttacaaaaaatactaaagggagtccttcaattgtaaacaaaagaatgctagatagcaacaaaaaaaacatattaaagtatacagcttggtagcaaaggtaaatatttaatgaatacagaatccttcaatactataatggtagcatatgaatcacttttagttctggtgtataatgaaagtattagtataaaaatacaactaaaataaatttatacacaatataagaaagtataattgtgacagtaacagaaagtgtatgtgtggaggaggaagtaaatatgtaaagttttttgtatgcaattgaaattatgtgttatcagcttaaaatagattgttataattataagacgttttatggaagccccatggtaactgcaaagaaaatatctataagagatatgcaaaagaaaataagaaagcaattaaacactgacagtataaaagtcaatgggaagaaaagactgcaagagaggaaaagaggaacaagaaaagctacaagatagacagaaaacaatgaataatatggcaataataagtctttatcaataaatattttaaatataaacaaattaaaatccccaataaaaagatacagagtagctaaacagattaagataaaaaccaaaaccatgatttaactataagcaccctacaagagactcactttagctttaaggatgcacataggttgaaaatgaaaggatgaaaaaaagatattatgtgtaagtggttagcaaaagaaggcagaggtagccatatttgtatcagacaaaatataatttaagtcaaaatctgtcataaaacaaaaataacatcttagaattataaaagggtgaagtcactaggaatgtataccaaatatatatgcacatagcacccaaatatgtaaagtaaaataggcagaactggagtgagatagagagtaacatgatgatagcaggaaatcccacactccccttttaattatggatagaaaaccagatagttgaccaataaggaataagagagcttgaacaacactatagtctgattgaacccaactgatacatagaatcagtctacacaaaaccagtagaataaacattcttctcaagtgtacatattcttctccaggtaagaatacattgtaggttgcaacacaatcttaagaaatttaaaacgattgaaatcacaccaagtatctttcttgcacacaactgaataaaaatagaaatcaatacaagaaggagaagtggaaaatttacaattatatgaaaactaacacactaccaatggatcaaagacaaaatcgagggaaattagaatatgtactgacacaaacaaaaatgaaaacctaacataccaaaatttatgagctgtagcaaaagcagcactaggaaagaacttcatcgtgataaacacctacattataaagaaaaggtatctcaaataaacaacctaactttataccataagaaactagaaaaagaagaacaaaataagcccaaagttagcagaaggaaggaattttaatgattagagcagaaacaaatagaaaatagaaaaacaattttaaaaatcaacaaaaataagaattggtttattgaaatatcaacaaaattgacaaaacctcagctagactaagacaaaaagagagagtattgaaataaaattataaattgagacattacaactgatgccacagaaattaagattataaaagagtattacaaaaattatacgtctacaaattgaataacgtcaaagaaatggatcaattcccagacacatacaacctactaagactaaatcatgaagaaatagaaagtgttaacaggcatatatctagtaagaaaattgaatcaataagcaaaaacctctcaacagaaataaagtctaggactagatggcttaactggtgaattctaccaaatatgtagagaggaattaatgtcaatctttttccacttgctaaaatattgaagaggagacaatacttccaacatcattttatgaggccagccttattctgagattaaagctagattaaaaacactagaaaaaaattgcataccaatattccagatgaatacagatgtaaaaatcctctgaaatttcctagcaaaccaaattcagtagtatcttaatagaatcatataccatgaccaagtgggatttctctcagggatgaagggactgttcaacataggaaaatctatccatatgatacaccacatttacagaattaagagtgaaaaccacctgatcaccttcatagatgtagaaaaaatttgacaaaactcagcactgattatgattaaaaaaattaaaaaaactagaaattgaaaaaaaaatctcaacacgatgaaggtaaaatatgtaaagcccatagctttatcacagtcattggtgaaaaaaaaaaaaaaaaaaaaaagaaagaaagcttttctggtaagatcagggataaggcaagaatgtgcactcttatcacttctattcaacatagtaccagaagtcctagctagagaaattaggcaagagaaagaaataaaaggcaaccaaatcagaaaggaagaaataaaatcaattatattcacataggatatgaccttacatgtagaaaacacaatagatctcatataaaaactgttagaactagtaaatgaattcggaaaatttccgggataaaaaatcaacatatagaatcagttgtgtttctacacgttaacaaagaacaattttgaaaaataagttaaaaacaataccatttacaatgacatcaaaaagaagaaaaaaatacttgggaattatcttaaccaagggaataaatgactataaaacattgatgaaagaaattaaaggagacacaaataaatggaaagatatcctgtataaatattggaagccttaatattattaaaatgtcattaccacccaaagtgatctatagggttgaggcaatcccatcaaaattccaatgccatttcatttttcagaaatagacaaaataatcctaaaattcataaagaaccacaaaggacccccaatagccagacagtctcatgcaataacaaagctagagggctaacttcaaaacatactacaaagctacagtaagcaaaataacatgatacaggcataaaggcagacatataaaccaatgaaacaagtttgagggtgcagaaataagcccatgcacatatagtcaactgatcttcaacaatacacaatgttgaaaggatagtatctgtgttagtccattgttgtgttgctgtaaaggaatagtggaggctgggtaatttataaagaaaagagttagttgccaaatggttctgcaggctgtacaagcatgtctccagcatttgcttctggtgagggattcaggaagcttataatcattgtgaagggaacgggagccagcatgtcacatgatgagagcgtgagcaaggggatgtggggtaccacgctcttttaaacaactagatctcgtgtgaactcagagtgagaactcactcattattgcaataatggccattaatgagggatctgcccccatgagccaaacattccccacgaagccctatctccaacactggggattacatttcaacatgagatctggaggggacaaacattaaaattatatcagtatcttcaataaaaggtgttgggaaaaattgaatttttttcacatgccaaagatattcagatgcaatagaataaaattgtattcttatctaacagcataaacataaattaactcaaaatagattaaagacttaactataagacatgaaactataaaattcccagaggaaaacatagtggaaagctttataatgttggtgcaggtcacgattttatgaatatgacacaaaaagcacaggaaacaaaagcaaaaacagacaagtgagactgtgtcaaactaaaatacttcaacacagcaaagtaaaaaatcaacagagtaaaaaggcaacctgtagaatagaaaacaatatttgcaaaccatatgtctaataaacaaacagcaatatccaaatatatgaggaacttgtaaaactcaatagaaaaaaagaaattatccaattataaatgggcaaaggacatgaaaatatacatctccaaaaaaaaaaaagacatacaaatgacccacatcttcatgaaaagatgctaaatctttttaaacaggaaaaaacagatcaaaaccacaatgaaatatcaagtcatccctcttatagatggccgacatcaaaacaaaacaaaacagaaaataatcagtaaggatgtgataataataatcctcagtaatcctcaataatcagagaggatgtgaatacattgaaacccatatcccctcttggtgttactgtaaaatcgtgctggggctataagaaatagtgtgaagatatctcaaaaattaaaaatagaactactatatgatctagaaattctactcctacatacttatctaaagtaactgaaagcaggatcttggagagatacttgcactttcatgctcactgcacctttattcacaaaaaccaagacatgaaaacataaatgtccactgacagatgaatgtttaaaaagttgcatatatgtgtatgtgtatgtgtgtgcatgtgtgtatgtaagtgtatgtataaaatagaatattattcagctttaaaaaagaaggaagtcctgtcatctgtaacaacataaatgacacttgaggacatcatgctaagtggaaaaagccaatcaccaggacagatactgcatgattccacttttatgagtcaccaaaaaatagtcaaactcatagaagcagaaagtagaatgttggttgccagagtccgaagaaatggggaaatgaggagttattgtctaataagtatagagtttcagtcatacaagatgaaaatgttttagaaaccttttctacaataaagtatatatagttaacaacactgtactgtataactaaaaaactgttaataagatatatttcatgttgtgtgagattttttcaccacaataaaaagtattccttgttatgacaaattaaaaacaagaaaatcactacagtatagtaaaggaaactgcatcctgaaatatttatgaattatttgagatcatgttgtaatctgttattaatctcaagtcgtacaatagcaatttgtttcttctaccaatttctcacaaagtgtggtctgcaatagccttcagtcagaataaaaactctggtatctaagaacatctccagacctactgaatcagaattatggtggatggtacacaggaatctgtattttaagtattctttccaggtgaaaattatgtacataaaacttgtgacgttgctttatatgaaagcttatattcatatatattatgcgctcctaaattttcacacacacacacacacacacacacacacaaagcaaatgttctcaatcaatataagttacattgaagttaaattcattgtttgactttgactctaagatgtgggtcacgtatcttcactaaactcttctaatcttactgatcacacttgataatccatactaatttcagatctagaaaattaagtaaaactattcaaagttccttaacaatatgaactagatttgaaagttccaaccactttcaacattacataagatcctgataatcatactatttgttttcaacctcagaaatagcaaaaaaatttaattttgaaaagcaaagaattgatggttttgaactttattaaaagcatcatcagcattttattcattctatagtaaagaaaataatataagaacttgaaagtctattaatgacagtaaagtaaactagtttattttgttttctaagattcaagaaaaatggatcacttctatggctaaactaatatcttgaaattcctttattatagacctaaaaatgtaaatatggtttaaagactgcaatttgtttaggttagccctgtgattgactctgatttatatgctgagttcaatttcagctttctattataaatgacctaataacaaatattctcacaattctcttccgacagaggagatgtggggattcctcaccatcagcaaagaagtgatcaattctgcagaaacaccagctgggctaactcaattcaattcaattcaattctcacactctacctcgatgtagcaactgagctacatctaactctattcaattctcacactctaccttgatgtagcaactgagccacaggttgaaggttcagtttcacgagattgcctcccactggccaccggtgatcattttaaccttcagccccaactcatccctagagccttggtctatctggcaaccaaatgtcatcatctatgggggccaacagctgtcagccaacttattagcatattagaagactttggagattctaaggattcaattcaattctctaactcaattcagttctcacactctacctcgtagcaaatgagccacaggttgaaggctcagtttcatgagattgcctcccattggccaccagtgatcattttaaccttcagccccaactcatccctagagccttggtctatctggcaaccaactgtcatcatctgtgggggctaacagctatcagccaactcattagcatatgaaaagactttggagattctaaggattttaggagttgtattccaggaaatggggtcaaagaccaaatgtatatttcataataccacactttgaagaaaaatttaagtgaaattaaatcaatatcaatatttcagtggaaagcttcagtgaggaagataatttaacaaaggaattaactttttgctttacgttaatgatcttcacgatatagcagagctgaattacaatggtaggctacaagcctttatttaaattttccccttagacatgaacaatgtgttttatgctagcagaagacatgagactcctgggccagagacaaaagaccttattacttatggcttaacaggcagcataaatatcattctcctgtcctctgaccaagacaattttaatgttcccctcagcttgagtaaatgctaaacagatttcttcttgattttaggcccctgacttccttcgccctttgagatgtaaagaatctttgagcctcttgctagttttatagctcacgtatatttgtcttaagaacttgagagccatccttctaaaaatctaatcattaagaaatatagtgcctctacctgtcaagctctgtgagagagtaggactctgactttggtaagtgccaatcagcaaacacagcctaatcacgttgacccctacctaacaaatagtcttcaatacttttccactaggctactccagcaattaaaaactctcctgccttttgtttcagtggtgttgagttcaatctctcccctactgcaatagtcttaaccacaattgcaatattgttgaataaagtttgcctccctgtttagctgtcaggtgcaatttttctttgaaattctgaagtctcttgggagcaatgaagagtggtccaggtagaagctgcagtaatagtttgtttatgtcactgctgagaaatacaagcataggaaactccagtttcatcagagggttgctagcaagtctgtccaatcttagctacggagtgggaagaaaacatggtatttattatcctgattaggagacaaatcttgtctctgacccaaaaggaaaccttatctgtatcttccaaggcttttagctatcctaacatatgtcataaataattttatatataagagttaatacttacataataaatgtttgttcatttggtatattataatttgaaaatattaaaatatagttatttcttgaaatacaaatatttttattattcaatcacatattagtttatttaatacagtgttcaacaaacatttttatagattgcctaatatatatcacatgctatgatcaagagctataagacacagtaaattcatgctctccgggagctccaatatagcagctaaataattttctagttgtgtaccacattcaaagaagtcagagccagagcacagagacaaatacagagtttcaagaggtgatgctaaatttatcagacaaggagaaggaaaggccatgtatatagtaaaaagaaagaaaagaaggtaaaatggctttaatatggagtatctgagggaacagtaaataccatatgagagtggctagaattacctggaaatataaacgcggtcatggcagaaaggaaagtttaggccactatcaataagttgggctttatttgtaaatgatgtggtgtcatttaagcattttatgcagaacagtactatgttcagatatggatcaaagagaggcaatgctctacactgagactgttattagaaactgtcatagtcttgaattaactacagggaatataaattcccaaaccttctttacccatggtgtattcatttcaaaaatatatttgatgtgtttttatcactcacgataaaaattgccaaattgtttctcaaaaatattttacagcagtattatatcttcattagaatttagttttaatgtcagcacatctgatgaaaaatagtctaaagtcaaaattatccttgtcagtttctgataaaggtgccattttgaagatccacaatctgtctttcaaagtactaggttactccagcaatgaaaaactatcctgccttttgtttcagtggtgttgagttcaatctttcccctattgcaatagtcttaactactattgcaataatgttgaatacagtttgcttgcctgtttaactgtcaggtgcaaattatccttgtcagtttctgataaaggtgccattttgaagatccacaatctgtctttcaaaataacaacactacttttttctccatggtaaaacagtttacaattcctccatggaaatatcagatgaagtagtggcttgtatttagggtccatgttttattaagataagtactctgtttttaaaaactagcagcacattcagtgcttactgaagctcacagtatcagggacatgagttggaactgacaaggattgagagagcagcagattcatattttcttccacaacccactgggtctaggacatatactcagcagaatggcaggcaacatttccaacagtatctgaatgtatccactccctctctcaaccatgtataattaaagccaagtaatttaaatagaaccagtgcaaatggactatactgtgtttttatttcattttctttgcaataatgctaattttggaccaaagttttaggcaaagggtatcatcactgttaaaaggggaaaaagctggttttccttttggtttctgtttattctttagtggattgtagattaatattcattgccttagaatttattaaagtcatgatacttgccaatcaatttttgtataagcaatttgtttggtggagatgtaacatgataacaataaggactgatttattgtcttcaaattctgataaaaccaggattgaaaacaataggagacaaacattctgctatgttacagaagggtgcgagacacagtcatgcaggatttagttaaaaatagcaaatcctcttatctccccaagctctacaagaaaataataacattttaatggattatttgaagggaattaataggctataaagaaagctgtggcacttcctctgtcagatggtgggagggggtccttttcctaaagccaaacgtgggagcacgttcaaaagaatgtagagaggacacccgccagcaccttctttctcaaacaatgtttgctgagctgcagaaatgtatagacgctatatggtacagaaatgaagtgttgtgtgagagtttttgatacacgtttgtgtgtgttctagagaatttggtaatatacatgaacctaggggctgttttccactggagaagtttaaaagcagcagcagtctgttttgagatacttcccatggtaaggtgaggagagaagggtcagcagttaaacatgtgtccttttttttccaccttttattttaggtttaaggggtacatggttaggtttattacatgggtacatcgtgtgtcacggggttttggtgttcagattatttcatcacccaagtaataagcatagatatgataagtagtttttcgttgttgttgttttctcttcttttgtttttcttttgtcttcaacctcctcccacctcccatcctccaccctcaagtgggccccggtgtctgttgttcccctctttgtgtccataggtactcaatgtttaactccaacttatgaatgaaaacaggcagcctaaagatgtatagggcttctatggcctgaggagatgatgcggataatgggctggctcctgttatttttatgtagtccaacctataatagggttagagtgagggtaataagatatggaaggaatgttttcacatgggtcactctataagggcatagcctatactagacaggtgagtagggacaaagtccctgtagcacttccaaaaaacagcaagcctgatatatgaagaagaacctcaatttgaatgatggacacatagagacgtcaatggccatatttcagcagcattttttctctaattcctttgctcacttcctctattgtttcttaaacctagaatcaagaatcaagtctgtgctgggaagaaagaagctacgactacgacatcaaattgaagttttgtttatataaactagacattttaatgtctgaatgtgtcagaattaccataataaaatttttcttttaattgaaattgattggaaagccaatagatagacttaaggttcagcaaaaagaatttactagagtataattgaaggcaaggtctggagaaaagtaaagtattttcctatttatatcacatagagttcaaccttcattccctgttcaatataccagctgcaagagtattaatcatttggcatatttgccttaatattctctttttgttgttttaacctctttttatttccattacagcgaaatgtgtgtttccatgcatatgtgagagaagacagttaatatgtccaaatttcatattttcctttgtaatctatatcttttatgtactgaatgagtcattcacattctagaaggtacaacaatgttgcaatatattctcattaaaattctaatgccttcaatcctcaaattaatattctaaacattaaattcatataaaatatatttgatcactgttctaaggtaagtacagaagaccatatggtgtgcttcccagatctccgttcaagactgaaaaacttattcccccatctactggaagtgcattgcgagattatttcgagctcttcctcaacttcaggaattgttctacctgaagaatgttgccttgattaagatcatgttcttcccagtgtcaccctacatctaatgatagccagatgcaggtataaaacaaacaaacagactgaaaacctaatcctttcttttctacttaagataacctgaagggacatctctagaggtctttatttagactgtatcagagcccattttctctggcgttcttcccggctcttccccagaagacaatgctaagagcccttaattgatactgatgtctacctctgcatcttgaaaaatctaatatgggacagaaaagactgaaatcagtcctcctccaaggtcagaagccatttattacaatgccattttttagtaattattattttctttctggtgctccaatggctccttgatcatacagtaaggaggcctatgtagtggagtcgacgcgattatgtggttatgcacgtgtatgcttctgtgcttgtgctagcacacacacaaacacatacgaatacataaacacacatatataacatatgctcacacataaatggggagaacaggaggattcatatgtttgttaaacaaactacaaaatgaaagataaatacaaatgaacttttaaaatatcactttaaggaattcttatttatcccttgggtaatgggttgtttttaaagcaagaaagtattattatctgaattttttcctaaaaggcaaatagtagccatgtgttgtatacataaacaggaccaatgcaaaggtcattataacacatgaggtgagagatgatgaatacctgaagctgggtattgacactggtaaaagttaagaggtactcattggaagctagaattgatggggcttggtgacaacatgaaaaattgaaagggagctttttttttaatgttataggctatttaaatcgattttattagaacacaaaaatgttatttttaatttaaagtattagaagtataattattctatagaaataaaaggcataatatattctttagtcacacatttatacctagactagtttcacgcatgagtgataaaggatgcattagccatattactgttcttcttgtgtttttgaaaccaagaaatattcagatttaagtttatacatctttaaagcataaaaaatgcaactgaataatttatgagcagtagcactgagactacttaaaaagaatacagcagtatttgaaaaattacatactaaaaatgcaaggttatatatgcaagaaaaaagacaaactcaagacaatatttcaggatctataaacataacagtccagttggaaatttccagctttaaatatgacatatgctgatgtgaatgacaatagaaaaaatctgaataatttagggacatatcaaggtcaaataactccctacttttccgccttttgtaataaattaccacctcacttttccagcagtaaaccaacctctaagtagaaagattctaaacataaacagataaagattatgtgggatgccctctctcaccactcctattcaacatagtttggaagttctggccaggacaatcaggcaagagaaggaaataaagggcattcaattaggaaaagaggaagtcaaattgtccctgtttgcagacgacatgattatatatctagaaaaccccatcgtctcagcccaaaacctccttaagctgataggcaacttcagcaaagtctcaggatacaaaatcaatgtgcaaaaatcacaagcattcttatacaccaataacagacaaacgcagagccaaatcatgagtgaactcccattcacaattgcttcaaagagaataaaatacctaggaatccaacttacaagggatgtgaaggacctcttcaaggagaactacaaaccactgctagatgaaataaaagaggatacaaacaaatggaagaacattccatgctcatgagtaggaagaatcaatatcgtgaaaatggccatatggcccaaggtaatttatagatccaatgcctccccatcaatctaccaatgactttcttcacagaattggaaaaaaaatactttaaagttcatatggaaccaaaaatgagcccacattgccaaatcaatcctaagccaaaagaacaaagctggaggcatcacactacctgacttcaaactatactacaaggctacagtaaccaaaacagcatggtactggtaccaaaacagagatatagactaatggaacagaacagaggcctcagaaataatgctgcatatctacaaccatctgatctttgacaaggctgacaaaaacaagaaatgggaaaaggattccctatttaataaatggtgctgggaaaactggctggccatatgtagaaagctgaaactggatcccttccttacaccttatacaaaaattaattcaagatggattaaagacctaaatgttagacctaaaaccataaaaaccctagaagaaaacctaggcaataccattcaggacataggcatggggaaggacaccaaaagcgatggcaacaaaagccaaaattgacaaatgggatcgaagtaaactaaacctacagaatgggagaaaatttttgcaaactactcatctgaaaaagggataatatccagaatctacaatgaactgaaacaaatttacaagaaaaaaacaaacaaccccatcaacaagtgggcaaaggatatgaacagacacttctcaaaagaagacatttaagcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcaatgtggcgattcctcagggatctagaactagaaataccatttgacccagccatcccattactgggtatatacccaaaggattataaatcttgctgctataaagacacatgtgcatgtatgtttattgtggcactgttcacaatagcaaagacttggaaccaacccaaacgtccaacaatgatagactggattaagaaaatgtggtacatattcaccatggaatactatgcagccataaaaaaggatgaattcatgtcccttgtagggacatggatgaagctggaaaccatcattctcagcaaactatcgcaaggacaaaaaaccaaacaccgcatgttctcactcataggtgggaattgaacaatgagaacacatggacacaagaaggggaacatcacacactggggcctgttgtggagtgggggtaggggggagggatagcatttggagatatacctaatgttaaatgacgatttactgggtgcagcacaccaacatggcacatgtatacgtatgtaactaacctgcacgttgtgcacatgtaccctaaaacttaaagtataataaaaaaaattatgtgtaaaaattaagataaattgaaaagtagaaaaaattatcctatattattttgagttgctgtgatatatatgaatatagatatgtttaataataacataagtattttactgcttcatcctgttttcaactttatatgatcttcctttagaaaatctacttttttatatatactttaagttctgggatacatgtgcagaatgtgcagatttgttacataggtatacatgtgccatggtggtttgctgcacccctcaacccaacatcgccagatattgtgggatctggccagcagccctcaatgcaatggggatctctctttgttcccagacagatcggcaggtcgagaaataacagacacacacaagatagtgaaagctgggtccaggggggtcaccgcattctggtcccgcagtaccaacaatgcactggatataccagcatttattactaagtttagtgagggcgcgggtaggttagtgagggatttagggtcatttcattatgaggtgagatggtcacatggggatgaagtaattctttaacataacatctgtatgcagaagtacagtatacagaggtaagaatttacaatatagtgtgtgcatcagtaatttctaacagagccttaaaacagaaacagtctttctataacctatgattagcaagatattaatcagcagtaacagttgcagcaaaagctggttacaaacaatccatagaagcaggacgtgaagctagacaaccagttagaccagaaattctcagaagggagtatgccttaaccctaaacagacctagaagacccgtggcaagatgagggcgtttatagccctatcttatccatatggacaggtgcccctcatgcgtccgtttataaactctccacaagggtcgcattccattcccagagctatgaacatctgcttttctgggataggaatcttggtgatgtgaaacctccctgactgcacgtccattcataggctctctgcaggcggaagcacatcacgcgctgttggctcattctggcagtccaacctggcattgtcttaacacaatcctgcatgcaattttgtatttacaataatcaggagcatttcatcttttattccgtagcaatagtttcacggggtctgcctacatcaacccatcatccacattaggtatttctcctaatgctatccctcctctagccccccagcccacaacaggcccccaagtgtgtgaggttcccctccctgtgtccatgtgttctcattgttcagctctcacttatgagtgagaacatgtggtgttcggttttctgttcttgtgttagtttgctgagaatgatgctttccagcttcaaccatgtccccacaaagaacatgaactcatccttttttatggctgcacagtattccatggtgtatatgtgccacattttttaaatccagtctatcattgatgggcatttgggttggttccaagtctttgctattgtgaatagtgctacaataaacatacatgtgcatgtgtctttatagtaaaatgatttataatcctttgggtatatcctagtaatgggatcactgggtcaaatggtacttctggttctagatccttgagaaatcgccattctgccttccacaatggttgaactaatttacactgccgccaacagtgtaaaagtgttcctatttctccacattctctccagcacctgttgcttcctgactttttaatgatcaccattctaactggtgtaagatggtacctcattgcggttttgatttgcctttaactaatgaccagtgatgatgagctttttttcatacaattgttggccgcataaatatcttcttttgagaagtgtctgttcatatcctttgcctactttttgatagggttgtttgtttttttactgtaaatttgtttaagtcctttgtagattctggatattagccctttgtcagatggatagattgcaaaaatattctcccattctgtaggctgcctgttcactctgatgatactttcttttgttgtgcagacaatctttagtttaatttgatcccatttgtcaattttggcttttgttgccattgcttttagtgttttcgtcatgaagtctttgcccatgcctatgtcctgaatggtattgcctaggttttcttctagggctttagggttttaggtcttacatttaagtttttaatccatcttgagttaatttttgtataaagtgtaaggatggggtccattttcagctttccacatatggctagccaattttcccaacaccatttattaaatagggaacccttttcccatttcttgtttttgtcaggtttgcctaagatcagatggttatagatgtgtggtgtttctgaggcctccgttaagttccattggtctatatatctgttttggcaccagtacaagttacctcacttgtatgtttattgcagcacttctcacaataggagatatgaaatacacttaagagtccatcagtggattattggataaagaaaatttgtacacataaacacagaccatgcaatactactcaggaataaaaaagaataaaattatgtcttttaggtggaactggaggccattataccaagtgacaaagtcagagacagaaagtcaaatattgcatattttcacttgtaagtaagaactaaataatgttaacagtgaacatagagcgtggaataataggcataggagacttggaaagtggggaggtgacgaatgagaaattaccaacgggtacaaagtacagtatttgggtgatgtttacactgaaggagtgaacttcaccactgtgcaatatagccatataataataccacacttgtgctccctaaaactataaaaataaaattaaaaagaagcagaatatgaaaaaattgacataattcatagaaaacactaaatattaatttgaggtacttagtttattaaaagaagatcttttcatacttgtttcctggtaatgaaaaaagtggatatacatttttccttgtgatattataattgtaaaagatgtcactacaatgataaatataaatggaaagtataattttccaattaatcatttataagaattgttttccataaggaactacaaagggactaaaacatataatttttttggttctaacacgacatgtagtatttataaacatgtagaactatccagttctggagaaagaaagtcattctttaaaatatgttttcaaattgctacaattttaaaaaaaggtggaaagacaattttcaatactttgcattatattttgtttgaaagatatactctaggctaattttcaactcatagagaaggtttatattttactttttagaattttggaaataataactgcaccattacattgtaagtttttgatcccttctttcatatggtcttggctcctgagatacctagatgctcagacatctattaagcaaataaataaataaataccatacacttcaaggtgagacaaagctttgtaaaatggtcttcataagtagcactacacaagaaaataatataaagcattctatcaaatttcccaataataacaagaagtcaaatagatttcatcgcttccttcctttcttcctattttccttccttctctttcttttcttctctctccagccttacttctgttttattttttccctctttcctccctttttcctctctcttttctcccatttttctccttatgtattctacaatgaatttatgctgcataattttacagttcatatagcttgtaactttgtaaaaatgaagaaaacatgtaggagagctctgatagagacacagccctcaaaagcaaacaatcttcttttttcctttcttttttttttttttttttttaagtcttgggccatagttacaacaaaactgtaccagtggtggtttataaaatgcaagagaaagaaagatgtttggcattttagggacacatttgctagtaccatcctgatttttaacatgaggttacaaaaaaaacctattttacaataaaacctgcagaagtcactagtctgatatttaatattagagaagtattaagatttggaaaattatagaatttcaagtataaagataatgacagagaaaattaggaaaggataataggaggagtaagaacttgcttttatgcatctgagtttagaaaatccatctgaatttttttaaaaagacatgaagtaaacgcaatgagatatggaagatcctatgtgtcttgtgaaataatggctcataagacactgaggaaatggtcaatagacaaatctaagcacccatctcagcttgcacagtacattgctggtttctatgggttgtcctagacctttgttttcattttaattgctttagtgtttactacttttaagaatgtcctgattttgatgctatagtcacctgatgaatacagaacccccacaaggaggatgaagaaagtagataatatctaagatcaataaaaagactgaaacttttgttctataactgaacatgattgtttaaaaattatgtataataacaaaattagccaggcgtggtggcacatgcctgtctgtaatcccagctacgctactcaggaggctgaggcaggagaattgcttgaacctgggaagcagaggttgtggtgagccaagattgtgccattgcactccaggctgggcaacaagagcaaaactctatctcaaaaaaaataaaaaataaaaaaatatatatatatgtataataaaacatatgcactctgtgtaaactagtatgtaaatatttttaaatttagtaacttatggagtttaatcatattgccatttgattcttcatattttttttttgtctcttgaagttgtgatgcaatttaatatttttggtgattgttaaaagaaacttcttcaggtatatttttaaaaagacaaatatttgcatttaaactaaattactccttcttgattataatttctaagcagagatcgcccttgtgtaatcagtagtatagaagaggctcaggtaactaaaactataaatatagttaacagtgtactttctggggtcagcctgcctgacttggaatcccagacccaacactgactggttatttcaccttctgcaaattgatgcacttgtgcaaaatgatgttaactagcaacgaggtaaaccattggcttgttgtagatttaaaaaaaaaaaaaaaactttgtaaaacccttagccatttatatttgtccatagtttgctctgctatgttagattgggaagacaaaggaaaaatgttcattttcttccttcaaagtgtttaataatctcaagaaaagacagtattgcgtaagaaaaattattaataaaatataaaatttgatataatgactaagagagaaaattccttaatctccctgataaagtcataaaaattttcaaaatgaaggagaatttgaggtgagaccagaaagcttaggaagagttgaaagagagcaaaggcaataatttgtgaaaaatatacattttacaagaaaactacatatcattcagtgatactgaaatataatatgcaagggcaaattaggtgtccatgtacatagaaataagtgttcatttagtttcttaaatgattaggcaccactgagaaattttcaacagcgagttatgtgtggaatattttaaaaatatcaacctctgggaaaagttaaatatagattgcaaaattagaagagacatggtatttatcacccttgtttggcaagattatgacaaataatattacagtaggattaataatatttcccgaaactctcagaaggtatatggctagtgaagagtagaattaaaacacaattctgttattaaactgcaggtgttctgagaaattctactgcatttattgaattttaatttgatatatacctcagatccaatgtaatcttttgatttttcttcatatatcatgtgataaaagagttttcagtgggaaaataggagaatggtagaagtcagtgaaggaaaaagagagaggaagttgggtcacagccatattaagctgatgcctattaaatatcaaggagtcaatcattgttatttttttttttactttgcctaccttagcaatgttatatctatatgtaactatttctacaataacattttataaatacatgcacatacaggtaatatggctctgtcaaaaagttgatttttttgttgacttttatagaaaactatctttatagtcaagtatgaagctatataaacatagttatataattacaaagtagcaatttggctattctatatcctgtgaatattcaaacacatacagaaacatacatggttctgtatttatagtgttaagaaatgacaagttaactgcaacttgagcattttactcaaatttggtctaaaataattattctaaagccgtatgaaatcccagaattcagctgggattagagggaatgatctagcttgttttggcaggagaatatataaaaggtaatataataggtctctttcctactcagcaatcctataaaacaaaacaaaagttcctctgcctgcagtagtgtatactgagatgaaagttaaagattctgttgtattcttcaaaacgactgatcttggttcctgagccagtatgcctgttctgattaaacattttctggcaaattctcagagatatatttaaaaatgtcatactcctggttaaaaaaaatctgtattatttatctaaacatctttatttactttaccatatttggttaaaaatgtaaactgattctaaaatacaattcgttgttttcaaattatattacctaaatatgctataagaatattagacaacttttgaagttagtaacttcgagctgattttaatcatttattttgagagtaaactatttgtacatttattcattttgtgtggttgttcttaacggtagtcttgattttcttagttgctatcattattacaaacctctttctctgtttttgataagctagattattaaatgaaggaaaattaatggaaaatataggggaagctaagatatggaaacctcttcaaattctcaattatataacaatacataaaagtatcgtataaattatctcactggtaaggtaaggcggtacttgagtcttgcacatcctaaaaatgaaatgctattttaataatgataaataattcaaagatcacttaagccattgtaaataaaatattaaactttgaaatgtattttatgcactgcttaaataaattgacaaaaatatttctaaagaaaatttaaaaatcatccagagtacttagagtgtagaattcttaatctatattgtttcttctgctaaaggtaagagctatcgaatagcatatgtcttcacttttaaaatacaccatattgaattctgtaagcttagtctggtttttgttaggataccaaaggcatgaaaagattcgatagttaaaaaattcaaactgcagccagattacatatattctgaggcatgtatatctcacatatatgtttttgtgtgtttgtgtgtgtgtgtacacatatacatataatgataattcactttggataaaaaggtatgttttgtctcttagttttaaaattattataattaacagtctaataattaaaatgatatagattaaaaagtcaattctcagtgtatatcataacgaatagctacttcatcatgtatactttagacattttaaaactattcttcacaagctaatgtgaaattcatgttaagtgcatattcacatcaaagtcacttttacattaagtgtttactgcaggcatgctttacaatgtccacatgatcatcaaggcttgagtgaccatttgaggtttcatcttgcattctatttgtgcaggtagtctttcagtagatctgacattgatcatctgtcaatttgattttctaatcttatgagactcattgtaaacaaaataactaaatgtatgcaggcccacagagaaaacacaacagctctgcattttatttctgacagaagcattcttttcaatcaagcttaaaaatagaagaaaataacagtatgttttcactttatgaattcttaccaaacgattgggtccgaggcatttagaatttaaaaacaactaatctaaatagaaagagcctggcttgtgaagttttaaaattagacgatggaaccaataacgagcatatgttaatgaagacatgaaatcatcacggcattacatctatcttagtcagagcctgtcagtatgcccattgcctaataaattgtatccctagtcacagtttataagacacaagaagacattttcagaacctacaaatgaagccaatatgtgacatttcaaaactgctgtactaccacaattagtggaaaatatacaaagtaacaaatacgacatttatttcacaaagagtggcttaaagacttgcctagctcatcagcttcctatgaaacattgtcaggtaatatttatgtgtgtcagggtgggagggagacggatatggtttaggtcagacgctgggggaaggaatgtattatttcaaatacggtatctgggaaatacttatttgtctgacaaaggtgcatcattatacataaagaatagttgccttcctaagcactgacacaaataaatatttatcttccgtacatagatgacttgcattaaaatttgtaaattttttattgcttaattgagaagcataatctctgaatattaatagacaacatggagagttaatgaagtttttgtcataatgcagtacatttctccaacattctctaataaaagtatttgtagctaactcaaaatactggtgggtcctatataattaatgcatcgattaaatatgaactacaggttatatcaataatataagactttttcttgaattataaatcaaaaagagataagagctgatgaaaactatccacatttacttttaggatgctaaaaaaatgaagaatgcatctagaaattgtattctatgtaactcagatggattctatctaactcagatgttatatcacatcttcctctgagtgttctcccacagctgtggtgtgcactactgttttttgtgaatttcaaggcaccttctggtttctattacatgaattgctaaaacatttaccatgctgcaggtgtctatacatgttatcctttgacttcctcatatacctttccttactaaaattctacaactttgcatcagcacagtgtttgctagttaattcttgaagttttttctaaaattccccacagaaaccattaaacatggattgtttcaccataagaaaaactaaagaatcaatcttcctgatattattcaaaacagattactttttcctacaattacttttctaaactgatacaacataatgtgtatttcttcaaactagtcaataagtagaacaaaatcaccagttttcacatttgattcagcacgagctttatttgctattcatgaattggatttacttcctatataaatatttctcccaatctttcttaccatttggtcaatgttaacaatggcacttgattcttgccaagtgaaaataattttaatttattatcttctacttgcatacgtattcgttttagatcacgtctatatttctgttttattatttttactatggctagatatgatattttggatgcttatttgtgcttataatgaagttgaagtttcacataattttattcctctttacaagtatttttatcaaaattatgaaaccctattttacatataattgaaaattgaaactaattatgaatttcccttacttaataaatatttgtcaaattttgctcaatattatggttcatactgggcaatggtaattacaaaacaaaaaaaaaagaacgatgcagaccttgctttgaacaagttcacaatgtggtagggaaaccaataagccaacagatgtaagtagtagtcatgtacccaatttcacagaaaaagtctgacatgaacatgtatagtagctgcagaataacctggtgtgtgtaatctattcatcctaaggcaaggagatttttaactgatggggtacttatcagcaaacagtcgagagagaagacatgaacattcttctgtaaaatgacaggaagcccaagtgctggaatgactggacaaaggaggtgaatggtgaaatatggaaagggacagtcctaatcaaagtcttattaatgaaggccatgaaccaaccaagctgagtttggattattcccttaaaactatattaaaacaggccgggcgcggtggctcacgcctgtaatcccagcactttgggaggccgaggcgggcgaatcatgaggtcaggagatcgagaccatcctggctaacatggtgaaaccctgtctctactaaaaatacaaaaaaattagccgggcgtggtggcgggcgcctgtagtcccagctagtcgggaggctgaggcaggagaatggcgtgaacccgggaggcagagcttgcagtgagcggagatcgtgccactgcactccaggctgggtgacagagcgagactccgtctcaaaaaaaaaaaaaaaaaaaaaaaaactatattaaaacatcacaaggatttatgaaagggagttaaataatcacattttgacttttggagagatcatagctgctcacaagactggaccctgggagaccaattaggaaaccatggcaataatccaagtgagagacaatcagaacttcaactaagaccgtgacagtgacatggaaaaaagagggaagcattttaatgatagatattaggaaacagagtctgcaagagcttttgacaattgggaaacagaaaagcccaggaatcaagtaggctacaccagaaatatccaaaggccaaatggggatactgtggctacatatatgttaaatattctatgttacactttaattattttaacttttaaaacttttaatttgtatggtagtattgatctaaatgtttttctttatcctacttctttaatattttaaattaaacctctggtgcgtaatattgagctataatatttactatattcattaagcctcaggcatacttttttacatttgccgtgtcagaaattggaatgcaccttatatttcttcttactgttaacatattaccagcaacacaaagcccatttcatgtttgggttttcccttatttcttaatccccatcccatctgcttcctttcacaggaaaccatttgtaatgtgtttgccgtacgttcttcagcatagatatagtcttgtaaaatatagtgtgggttttgtgtattttcagttccattaagggttttgtaaatcccatctctgtcctactttactcatccagccttgtttggggaccaatctatgtcacatatctggtttattgtttcatattgctatacagcatctcatagtgtgatttactgtattttattaatccattcttctggagatggatacacaggttgctttcaactccctaatgccatatacaccatccttgtatagatctttgcaataatttctcaggagtatatatccaggagaggaatacttgcctgtactttttaaatatatttcttcctcaaagagtattggaaaatttatttgactatgaatataaaaatatttaaaattattctcccattattgaataaatgggattgtggcaacaggctacctatgtgcataaaataacacgaatgtctattttactccttatgccaaaataaatcacagatggataagtattcaaacactaagaagaaatgaagtcatattaatactgggagaaataacatgggaaaattgaaaataaatctgtccatttttctaggttccctattatcatcctccttcacgcttgttcatctctctgcagtcaagtctcctcacacaactgccagatgattattttaaaacaactgaccaataatactcttgcactgttataaaaatctcagtttaaacattaacttgcactgcaatgcttcctgactacccagtctaaaataccctcccaggcaatgtcttctcaccctatttgaattatctggatagcttttattatttattattttcttccttatttatttcttgattttttttctcacacctctccagaaataaaagcttaacaaaattcacaatctttgttgtctaatttgtcactgttttctcaggacctagaatgtgcagggaatattaacagtgcatttgttgcataaataaataaaagggcatatacatatatatagagagagttttttggaacaggaagctttgtaatatcacagtttagaaatatttcataaggcattgagttgcattcttttaatacttgaacatatttctctgacttcagtgcaaacccacaaaggtagtatcggacatttaaccatcaagctgaagccaaacttatatttaacgagctaatatcaacatgttgtgccctatggggtaatgactgacatgtgcttaacaaatcgtcaccaccacagggtagggagatgattaggatcagttttctgccctaccatatcctcaatggctctcagttatttcttccgtgttttggagagaatatttctctactttgtttctttgactattttctttcaaaaataaaagaatctttttttctcattacattttatttgtaattgctgaagctacttaattttacattaattttcaatgtttcaaaataagttgtagtttatgaacaacaaaaaagctcactaagcttaatgacagtatttacactaatttgatgattggcttacttattttctgtaataaccaagaaaacagattagcttataaagcatataaggtggccaggtgcggtggctcatgccttgtaattccagcattttgggggacccaggtgagtaaattacttgaggtcaggattttgagaccagcctagccaacacggtgaaagcttgtctctactaaaaatacaaaaattagccaggcgtggtagcacttgcctgtattcccaactaattgggatgcagaggcaggagaatcgcttgaccctgggaggtggtggttgcagtgagaagagacagcaccagggcattcctgcctgggtgacagagtgagactccacgtcaaaaaataaataaataataaataaataaataataaaataaaatatataaggcagtgtataaatacatagatacatatgtgtgtgtgtgggtgtttgtgtgtgcctgtgtgtgcgtgtgtgcataatgatgattaattttatgtgtcaacttggctaggccatggtgccatagtatccactttttggtcaaacatcagtttagatgttgctatgaaggtaattttttagatgttattaacatttaaatcaggagacttagagtaaagaaaagtgccttccacaatgtgagtgagcttcatccaataactttaaggcttttagagaaaagactgaggtcctctaaaaagaaaagcattcagcctctaaactgccttccaattagagctgcagcattaacccttccctagatcttcagcagctggccatgcaaatatcagacatgccaacctgcacaatcccatgaaccaattccttaaagtgcctctctctctctgtctctcctctatctctctctctctatatatatactgttactctctctatatatatgtattgttactctggagaattctgactaatgcatgcacatatacaggcagatagatacataaaccataaacagatacatagaaagatacatggatagatagatatataataagaaaatatgtgagcaataattctttttttataaatttaactatgttagttgctaatttccagacttatatcctaaaatgtaaataatacattgaataaaccactttaatggttgcatattaacttataaaatagatttttgctaatattacatttttattgagaatatattcctatcaaaaatttgaatgagcaaagtgcattggttccatgtgtatttattttctacatataaaaattgaatttatatttatatttaaaaatattaaaattatctattatctatatttacattgaagttacaactctatgaatgataaattaatactttggaagtaatgaaagaaagctcctagaagaaatctgatattttgaactaacaatgtgagaaattcacattatctcaattaaagtattttattgatatttgggacatctaatgaccttctctccaagaccttgaggacagaaaaatgaattgtttctgaaaattaactgtaaattcattatgtaatggattggcatggtgctacaaagtcacttcaaagatgctgtccaagactgtcagatctggctgtaatctgttaaacacagtattaacatgtctggagaacgactgagcgaattgaaagtgggggtcgctgagaaggaaggtgaaaagaagagccatggaagcaatattaggcagagtcttcaagcagattctaaggaggagtaaacgctgatataaaaaactccactggaacaagcccagtattaaatatgccaccactgtgcatgtggatgctttgaactttctttgtgtaataaagcatgcaaatcacataactcataatccttaatatgtattgagttctcagctcacaaatacagtgcatagcacattacatacaatagtttatgtaagcttcaactcaactagatgagatgtgtactattgtctccatttcataaaaattatctccattttatgaaaattcacttgctaaaaactgcaaagttaatgagtaacagactaatagtcttaaaccactgtgtctgacttcagagcccatgctcgattactctgctaagctaatattttccagattcagattctaaattcaacaagttcagttacaattataattcaggtttacatttacttgttcaaagaaagaatgtgtgcttgatggagagtatatctcttcagactttgatgtggttctatttcttgtcacaaaataatagactgttatacatttataacttaatattcggttatatttgatttctcagtagctttcccaaatagataaaatataataactcaagaatagacaccttctattcatcagaaattttagttagcaccatgaatttagtaaatactattttgatcattagaaaatgcacttggtgaaaataagcataacactgaaagtaaaatgcaccaaaccttacacagcagtgatgcactcactctctgagttctcttggggcaaaacccagaatatgacctgaggcacattttctaatctttgtttcttccagttcattcaaagttgaaaattgttttcatctttattcagcattattttccagggttatcttctgaagtgttagttttattatatttaaaaatagaatttcctctgggaacacatggttttcttaaaatggtatttttttcacttttttatttcaatgatagagaagtgtaataggcatttatttatatcagttgggctagcaaaaacttgtatgattagaccaccttctccagtgttatatgggcaccataaaagttactatgagcctctgcaagcatacatgattttcattaagattattaagtggttagctcctgacaacttagggcactcacagggagcaattaactctttggctactgccatttagggcaggagcttggccagagtcaaagaatctgggctgcatagaggaaaatttattcatggagcagctaagcatagcttaacgtactcagggcttgttggccacccttccccagaaatgttttatttcttttggtcctttcctcttttttgttttccctaagttttttgttattgttttaaagatgctacagaaggggaaagtggaaccaagtaagtcaatacagttttgttttgttttttaacgcattaactcaatatttgttgaatgcctccaaatcaaggcttggtattaggttttagtaattccatggaaaaaggggcattgtgcttattccctatgctcacaagttattctctagttggttaaaatgcagaaaattatacaaattttgtctgtcatttatttatggcaactgcaaacatggaagtttcttcatggtttggcatttgagttcttgaatattgagtatagtcaggattaaatcaatatcaatgcccttttcctttctaaatagtaaaatgttgcaaacatttttgtttaaaagggccatttttaggccaattaaaactattaagttaaaaactgagaattatttttaaaaaatctgaattattaacaattgcaatttttgttgataataaaaacacactttatccactagtaatattgtatttccttaatcctgctaataatataaactgaatcattattacctaaatattaagttttaaataaaaacttgttagaattgataatataaatatagtatgaaaattaactgcaaagtaatatatatcaaaattaatggcaaaataatatatatcaatatgttgcatgcttcaatattcatttcatatgtattttagaaatcacatttaataattttaggcagaatgattgatagacatatactcatatgatatagatgatatgagtatatatatgagcatatatacacatgagtatatatatcaatagtttctaatattatgcaattaactttgaaaataacattaacctttaaggtaagcaatggtcccttattttaatattgtatactaagtaattacaaatagttcaacatacctgatttctgaaatatttaaataataaagatttttaagctcattaaagtcataagaattaaacagaactaataaatcttattgaaccataaatctcctaaataataagactggtagtgtattaataaggtaagagtgttggacctgtgaaacacctttacgttttctttttaaaaataaataatcacactacagctgttaaaaaatcatcatatctgatcagttgtaagaaaacttaaacaaccacgtacaaaggaaacactatcctcacagtgccattgaagaggaaaaaaatgttgatcattaacatgagaataaacatcacctccaacaaaactagtatgagtatctctagatttatggccaaaatcttttctaaacaaactgaaaaatcatacaatttcatttgcaattgacatttcatggccctatgtatatgctagcagacaatgggggaaaacctcaaaaatcgaaagcaatcataagtacttcatgactaaataaagattctctagcaatcccccaaatcctgtatctcaaaggaggtgaaaattatattatttgtatatccaaggaatataaagcacatgttgtttttgattcaaacagaatgaatatccttaagcaaatgacagagaaaatttagtgaaaatgttttatatataataagtaaaaataactggttaaagaaatgcttatgattataattagagatctttgtagttgtgttcagctaggcagtgtttttatctagtaatagaaaaataatttctaggtggaatcaagtataacttaccccaaccattagccaaggaggcttgcaaccctaggaggcttctgattacggttaatgtctggacatgcctagcgtgtatcactttgtttct

SEQ ID NO: 1368 - DNA, 377950 bp, Homo sapiens
ttattcaaaaatgcttcatttaatgaagtttgttataataattttggtatgtgtatgggtaatacaatgatatgtactctagaattgcttaaatgaatgatttctatatcattttactataaggatttaagaaccaagattatttggttttctagagcataataaagagagaaaatatatcagtgtatgtaagtgccttagacaaaaagatttagacacttgatctagtggtttcaagactggccccaacccaaaaatacattcaatatgacactttcatatgcagttcgatatcttttttgctttaaaggtaaaaatatacccacataaaacttttacttgaaggcagaaaagtttgcatagtatagccaaaataaataaataaacctaaaaccaactattcaacttgttaataaaatcacggacatcacggcagaaattacaatagtcttagaataaataattattagacttttgggatcagaaataatttaagaaaatcctggtcaaattatactatacttttgtgccatattcacataaagctctatttttacaagcctcctgactctacagaaatagtttttgaaacttcacctgattttcttatggacttttagattctacactttgaaacagaactcttacttataactgaaaattatgttttggatatatttaacattacacagaaaatgtgaatctcctaaaatagcctgtaaaggaaacaggttaaatttaaaacttccagaaagaaagccagaagacacactgctataatcaagcaacttgtatgttcagaaagtgaaaaaaataattactttagtactttaaaaatgtgttcactttctaaatgaaacagaagaaccatgagatgtgttctgaagagtgtataatcttacctatgtatagtacattacctggggacaggtatcatgtctcattgtcataacattttgaaaaatatcttccagttagaggagattcaataaataataaatgtatgaatgaatatatttcattctgttatgatatttctggtagcaagtagggattggtgacttagacataaatttgaggcttcaaaaacaggtgggagtcatgaacacttcacagtctgggcatggtattaagaaattaacatcccagacttagcaaatctttcctggtcttaagtaacaatatggctggtatgatttagtctttggctcattaaacattttataaacccccagaaaaattttttgaagatttcagggcaaaaaaatgtggtaatatgcagacctgtttgcaatacatcatttatataatgaattttaatctgcacccatttaaaatacactttaaaagaaaatgtttatacgctattcattaactttgtgtccgttaacatcatcaacattattagtgtctatcattataatactatcattattttgccttataaattgagtttaattgaaaaatttctccatcccgaaatcacaaagatatttttctacatttctttcatttatatcgtcattttaccttaaacttttagatccctatacacatttagagtctacttctatataaggtataaggttgtaatccagtttcatttaaggtcttattatgagccatttcctcaataccatttactaaagaaccctgtatgttcaaatgagattatagccaaatttctcatatattgagttcccgtatatactcgggttgttgtcagagctctctgttgacccattattattttttttcctttaaaggcacccatatgtgttatgtagtctgtcatgtcatatggttcatcagatcccaccccattagtcttccttttcaaagatgacttcataatttagaaaatattattcataaatatatataacatgataattagtttctaaaataacttgcaatatttttactattgcattaaatgtgtgaattaatttgggaagaattaatattttagctaatttaaggcctaatatttaactccatgcattatatttccatttattcagtgtatatataattttctctttttcattgagcttagtggtatatagagggtctttttaatggagaattagagcatcttttttttaattctaaacattttgcatatcttttgacattataacaggtggtatcacacatataatttctagatattgcaactgatatagagaaacttaattttatataaaatacttgtatctgcaacatttgttgggctccattgttagtattaattatgagacaatatcaagaactcattaaagtgttgataaattacaaaaattttgtaatttatccaagattctctggatatcaaaaaataatggcaaacaaaagagaatcacaaaatcagaaaaaaggaaataacatcacaaaacgaaggataattttcttagtaaataaaaaagcttctgaaaatcattgtttcattaaacaagtatttgttgagcactattctatgtgtcttttgtggcttactacttttccttatcaaaatgttttcaatgtttattcgtattgaagcacatatcagtaattcatctttgtctattgctgaataacatttcattgtatggatataacaaattttatatatccattcatcagttgatggtcatttgggttgtttcaactttttgactctttcgaacaaaactgtaaacattcacatataaatttttgtaaagaacatatattttcaattttttgagtatatactagaagtagaattgctgggtgtaaagtgttatctcattgttttgatttaaaattccagtctttcagcctttcaccgtaaagtataatgttagttatgtttcttcattcttcttatttttttttaacttctcttatcagattgtggaagttcccttttattctttatttgttgagtgtttgtttcataaagtgttgtgagattctgtaatacaatttttttctccatctacattatcatgcattttcttctttatttattctattgatacattaaattacattaattgattttaagccactaaatcaaacttatattcttacgataaatcccacctggtcatgctgtataaacctttctatatgttgctgaatttggtgtggtatcaccgtgttgaggattcttctgtgaattaatttgggaagaattaatattttagctaacttaaggcctaatatttaagtctatgcattatatttccatttattcagagtatatacaattttctcattttcattgatcttagtggtatacagagggtttatagtgctatatagagggattgaaaacatagatttgcctatagttttcttgtgatttgtctggttgtgctattgttgtaatattggcctcataaaatgagttgggaaatgttctcttctcttctatttttggaggaggtggtgaataactactcttaattttgctttaaatatctgttacaatgtctcagtgaagtcatctagccatgaacatttcatagtgttaatttttgttagtttgtttaattactgattcaatctttttacttgttataggttagatttcctacttcttcttgaatcaatttcagtagttggtatttttctattttatcgaagttaactaatttttttaatttacagttgttcatagcatttctttataattatttttctttctgtaatttcagtaatattttatatcttattcctgattttagtatatttgttaatgtttaaaacaaatgaaattttgttttttgatattctttattgtttatctatattttattttattaattttactctacattttatgatttccttctttctacttattttatttaggtttagtttcctctcttatccattgtgttgtggaagtttaggctattgaggtatttacagctataaattttattcgcagcactgcatcacccacatcccatgagttttggtatccattttcaataatctcaaagtcttttctaatttctcttgcaatttcactttgattcattgtttaataaagattgtattatttaacttccatgtaattgtaaatttatcaagttacttattgattttgatgtttaatctcattcaattttggtcagataatgtcctttttattatttcaattttttgaaatatattacagcttgctttatagcatagcgtaggatatgatctatcttggagagtgtgccatgtacatttaagaaggttattctgctgttgttgggtaatgtgttttatagctatctactatttctagatgatttatagtgttgtttgaatctcctatatcttagttgatttatagccaagtgttatatctgctattgaaagtagaatattagagcctctaattgttattgttgaattggctatttctcccttaaattattttttagcttcattattttgaggctctgttgttagttgtgtatatacatatatatatacacacacatatatgtttgtaatcactaccttttctgatagtttgattcttttataattataaaatatctttctttttctctactaactgtttcattttttctcttaaaatctattttttccctgatgttagtataggcactccagttttcttcttgatgcagtttgaatgatatttttttattgctttactttcagcttatttgtatctttgaatctaaagtgtcttccgtaaaccatatatatatatatacacacacgtatacataaagtgtatcttctatagatcatatatagttgactaaatcagaaaacagccagtctaaacgtctctaaattttgactgaatttctgaaatcactttatttaaatatttttgatatatttgaatttatgcctgccattttactttttgttttccacatgtcttatatctcttttgtacctgtatttttttcattgtaattattctaatactagtttcttttatactaagtaaatctctagggcaatattttattttattgtatttattttctcatgatagggtctcactctgttgcccaggctggagtgcagtggcacaatcatagctcattgaagcttctaactcctgggctcaagtgatacttcttcctcagcctcccaagtagctagggctaggagtacaggtgtgcacaaccacacctggctgatttttttaagttttttgtagagacaaattatcactatgttgcccaggctggtctcaaactcttggcctcaagctattctcttgccctggcctcccaaaacactgagattacaggcttaagtcactgtgccagaccctgagggcaacattttaattttgttaatgctaattttactaaagcatatgagtttttgtttgttttgttgttgttttttgtagttgctttggagctaatcgtacacatcttaacttagcagaatttaccacagatttatgctaacttaattctacaatgacatagagaagttatttctatacagatatattccttcttccctccttttattgtgctagaattgttatacataacatgtattatgtaacataatatataataactatatatgtatatgtaagtgtttgttatggaaattccaatcattttaatcaacaaaaacattgttaccatgaaacagttcgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttgagagggcaaaattcagtctgtagaaccttgtctccagggagataatttgcattgccaggagacaaaaaagggaaggagacgtttctcactctactcttttgtaatttccatcttttaaatgtgaatgtgaaatttactcagaaaggtaagttacataaaatttaaataatagggttattgtatctacatggtcatgtaaatattaagtatctccattaccatggcattttactaaataatatatcagaatataattaattcaataattttgttttacagacctaagacacatgcatcagtactttgttaggttttgaaaaatgtcacagaaaaatatctgtatcctcaggaaggaacagcccattaaaatattattcaaaatcaacaagtatattccaagattaattcagcaaaagtggagtgtatttagtaaaattgcaaatgttctatttggagaaaagattgctttgaaataaaagttaattcaactcagagagaaaacaactataaatattaaggatacgatcaataaagttactaaaaatatggctgtgcttattcaagatttagaatccaaacagaactcattgggtctagtaactactagcctgaaattaggaagatttgtagacaacaaattacaaaagtaattgagagactaagaagatttaggacaataaatgtaagaattctcttttaattgaaaacctaattttgtagaatgcttaaaatataactaatcagtcatagataaaatagcatttgtaagtactctacacattgcattctttgaagcaattattaatgattaatactttactctgtgctgttatttgaatgtcatagatctgtataaaaattaaaatgaaatgagacagagtccattcaaaatggcataatgcataattggatacaattttaaccttgattccattgttctatataaagctactatttcaatttaatatagctaatgttctaaccagaaatttataatgttaaatacttcatcctaaaacttcaagtgtcatgtctcccccagacagggatattaaaggccattttttatctcaaggtaagcctgaaatatagataatatattaatattccagtatttcaaattgtaagcattaaaatgtcatctaatgaattttgtggttaaatataatttgacatattttaatctattcaattgcaatgagtaattttggcactttgtttcaacttttaaaaaagtgaatttctcataatggatctcttaaggaattatctattaacataattagaaattaatacatgttattaatggcttaatcaaagaaactgtaaattgatgtgggacttctttgcaactttgctgtgggtctaatcagtaatatttcatgtactcgtcttcacccaccccatcctttattaaatatagaggggaaaaaagtggctcatgtagactaggactggttcaagaattttacaaatatatgatttataaagtgatatggaggagagacatgaaagaaaaactgacttattgtacagcaaacgttttaaaagccacttaacaaaaattaatgctatatttgctctatttctatacaatcagaaactattaataaatatatatctttcatctataatggccagaattattcttagtaggcctcaggaatggtcaaagtaaaatttttgccagggaaacacaataattgccaatgttcaatacttggtgtgccagtcaatgagggaaacaaaaatgttgctttacaacaatccctcctaatgtttaatgttactgttaattgctttatgtaaactctatgatcttagttccttagtgatgctcttattaaccaaaatccttgtaatacttaaataagtacctatattcacctaaccaaaaatgtgtatatacatcatgcttttattagtcccattagtaaataatgaaaatcatttataaaaatgacaaataaatatctgtaaaaataaaaaaattagtagcaaggtaaatccattatatctctattatgtatacatccaagtctttagtgcactgtgattcctattggtgatttttttcaaaatgattttaaaatctaaaagcttggctgggcatggtggctcacacctgtcatcccagcactttgggaggctgaggccagcagatcatgaggtgaggagtttgagaccagcctggatagcatggtgaaaacctgtttctactaaaaatatatatatatataaattagccaagtatggtggtgcacacctgtaatcccagctactcgggaggctgaggcaggacaatcgcttgaacccaggaggcggaggttgcaatgaactgagatggcgccactgcactccagcctggtcgacagagtgagactccatctcaacaaataaataaataaataaataaataaataaataaaagctttctgagaacatttgatcttttaccagtgttttgttggaaaagcaggtgtgaagttatttcatttatagggaatactttatattacttcatgaatttctggagttatgtattaagacatcacccacagtcaggaccaggaaacttaataaatagaaattcagttttaagattgtctaacgaatttataaatttccccttagtcctgtttatagaggcttaggcagactagttttcaaagaacaaaggctagctctcatgtcaactgtattcatttctgcatgtcattctgaaccaaagaaatggatgaaactcatctgtacttttgactgagggaattacatgatattttgctatcattggaaaacaaataaaatgatctttctttactttcaacaaacccatacactcccccatcactatccacacaccatcatgattctacagaaataaataaactcatttagcctatcccaacagagggatttcacaaatttagaataccataaccaagtagtttggaatactcctgtacaaacatgacagattacatgtgtaataagtgacaaagaaatacacctaagaaatgttataattatccctattttatggacattttttgttttgttttttgaaagatgtaaccacattaaaatgtttatgcctagtatcttacttgcaaactctaggaatgactttataacaatagtagctaacactcatgttactaatatactgatagtggtatactactatttcatttcatcacagtaatggcaagcggattgtaatattgatccctataatgcaattttaaaagttatttttaaatttaatttaagttacataagtgacaaaaaaagaaatttgaattccatgtctataactcaaaggtactgttctaattgttagataatactgctgtaaaatctttttaattcccttctgctctggaataaaatctaggttataatactccagattttaaatgagggctcaagtatacttattttaatattgttttctcttaaactaatttgccgtaagaagaattttatagagaatattaaatataaaaatgcagaggatagtttaatggtatatttatgtcacattttcagtaagacaattactatgcttttcgttaagtaagaattactttatataagtggtagaagttttcttgtagtgttttatacaccttaaggatgccaaaagtaaaacaaaatggcaagtccgagccggtattccactacaaataatattttaattctatgactctcatttcatttggatagctttgaactccatctggtcactgacaggagggaaaaaaagtttgagtttccattttcattaatatcttcactttttaaagtggaaaatggaaagcttcaactgctaacaaatcagcaactaatacattcataaatgaacctgctcctataatggtctaaagtggctctctgtttaagaaagcaattgatgcaattggaccttcctattattttctttaaataatgaagttatttgtttttaaaatacaagtgcatttatattcacagtttacatgagtggacaatattatatttggttttatgttttacacaaaatagggatattgacagaatgttaatatgttcatattaacatactacctaacatatcttatgaacatattacttaatgtatcttatgacctaacatatcttatgaacatattacttaaaataaaaaaaaaaaatttcagactacagaaaattaaagcagaaacttttgttgactggatgaattctaagggtgaataggaaatatatttcagccagctatgacaaatagagaaaaacacaactgaaaaagaaccccagccatctatctttgatactatgtctctagttagctacattaatttaataactcatggactatttctgcatcatagtcttattacctggaaaataggtaggttgtattagatcaacagttctttgctggatgattttgcatccccatgggacatttggcaacagttgaagacattgtttatatcacaacagtgggaagggcgttagggctggcaatactggcatctactaggtaaaatggaacaggagaactccacacaacagaaaattatccaatccaaaagagtaatgtcaacattaggagaccctagaacaggcggtatttatggtttctatatctgggatttcaggatgagttttttagagttaattggggaacatgaggtagagtaaggggctgagatgcctttttaccaattaggtttttttcaaacaaaaatttgaagaattagtaacttttagttccaactgaattatccagaatgttctataaaataccttcaaacgaatcatttttctttgaaaatactacgctaaggctaatctttcacttttcaatgtggaggtccccatccaaagtttatggcatttatttatccagtcttacaataacatcttacgttgctatataattataatatgaatattatggatgatatacatatctttataatccatttaaatcacttctaaagcatgaataatatatatgtcttttacacatgcatgtatacacacaaatacaatttacttataaacctattaagaagttagcactatgggaatattatatatattatatatatatataacatttttcatctctctgtctccaaactttgtgattttataatttcaataaaagtacaattttgttcaaactgtatttgtatcttatgtttctgttcatgcttctgcaggatattttacaagataaaagtgtggtccattgttatttgctttactaaagttctaaattttaaatactactaagaccaccaggaaaatactttctaatttattagaaaatacttacaataaagcattaattcgataattcaagaatgccaatataaatacatgaaatggaacacagttaaaaataaatgtatgaacagtcacataaaccatttcatgtcatcattttctgtatttaccaaagttatagctctttcgaatgattattgctaatgtattcatctctgacaaagcacaattatttatttaaatgaatgaacaaaagaaataaacagactggctcattttcatgggtgactgactgaaggaatttaagacttgcttcaataatcctcaattcatgaatctagatggtataaacacatattgataattttaaaactaaaataatcaaaaatgtacattaaaatatttttaaaataaactgaattattattcatgtaaagaatttgaagtgatataaaaatgttaaataaataatacaatgcaattcagtatattatttcaataacagtttttagtgtactctttgaagcagaaatattataacattctttgtcataatgagaagacaattttaaacatcttttccaaatattaaggttgtctggcatatgagactacatttatgtgactgtatgttgtatttcaatgatgaatgagttttacctagaaaagattaatagaagattttaataaaagtaaactatatgagagtcttacagttattgttgtaagagctaaaataaaagcttcacttatagaaaaaaatactaaaaggtttagtaactactcaatatgaatttgcctgttactaaaatattttattattaggttgttgcaaaagtaattgtggcttttaccattacttttaaaggcaaaaagagcaattacttgtgcacctagctattcatagaaggaggaaaatcaatatttaatttaacattccatgttatgtggccactcacttatttggtggtttcaggctccattttggggaattctacagtttctttatggtttcaggaatgtctgcattaggagaggttgggagagagggtatcttgttggatgtaatttcttcattttactttaatcaaaatagtttctcttgtaactatacacatagagaatttcagaagaggcttttaactgaacagaaggatttatagaacaacaacaaaggtagataatttcaaattaatatggtaatatgcactgctcttacactgatctcttggtcaagtaatttaaaacaagaattaaaaactaaaattgaaatttaggtaattaaattctatgaataattttataaccaaaaggggcaactattgagatgctggagattaagggtatcctatcttaaggaatgtagccattgtggaattaggacagcacttttaaatgtagaacatacctgcatttgtttcttgtcaagttcaccattagagacaaaactgattgtcagaactgtggaacatttgagtagcaacatactttttatactgacaattaggttgaaacaaccgaagaatgaaacgcataaagaagtgtgttcatgcccaccacagaataagaattgcacttaaaaagttaaggaaatataattttgataggaaaatatttgttattagagagaataaagaaattttgtaaagtaaaaaataaacccattgacatattgagtagtagtgtgtacattccctgtccaattctattacaagcaagtctaaatctagagccactaaaatttctatgatagacagtttatctttaactagatgtattttttctgttcaactaaaatgccttagtaatttcagtacgattttttttcttagatgtcaaacatcttttaaaattcaagttatggatcacttaactctaaatacatgcttttattttatttccaaagcttagaagacaaagattattaaaatctgagtgttcaaatataaaatatcttgaagtatatgcattaaatgttccatattttaggctaccattgagaagatgtttctctaagcaacatttgataagactaatcatgaaactaaacagccagctgtttagattatagtacaatccttgctgccatgtataacactattatcatcattggttttataatcctttggctcaacttactacttactggagatagccgaagagaactaacaaagcttttaatgtgatggtgttaaaaggtgatatggttcagttgtgtccccacccaaatctcatcttaaattgtagttcccataatccccaggtatcgtgagagggaccccatgggaggtaattgaatcgtgggggccatgtccccagtgctattctcatgatagtgagaaagttctcatgagatctgatggtttttgtaaggggcttcccccttcccttagctctctccttcctgccgccatgtgaagaaagaggtgattgcttccccttctgccgtgactgcaaatttcctggggcctcttcagccctgcagatctgtgagtcaattaaactgccttcctttataaatactcagtctcaggtatgtcttcattggcagtgtgagaatggacttacacgaaaggcgaacataaatccctttctattgggacaacagtatttggagttaagagttaaaaagaaaacataaaaggatgaactgtaaaccttcattcaaaaataaaacagcatattatattacactttcatatgcaataatatttttaaaagttcaatgtaagtataaatttgtgtgagatataaccaacttattatagttgtagtttcataaattaaaagatgtggatgaagttccaagatttgaaattactacgcttttattatcaaagttaaagatggcagagtaataataattatcttaagtttgaacaataaatcattcagagggtggtgcccagctggttgtttacttttccccttagagaagattgaggaaatagtattaagatttactattagaaagatgtttagaagaataattttgtgacagtgattaaattctaaaatccttgatccaaaagggaattgagagtatgaaattagataatgaaatttcctgctgtgtatcacatgccatcactgaataaattctcttgccacatatttttgtattgtgtttcttttcctctgtgtcataaacctctatccacctcatttaacatttttactgatttttttctcccataaatcatattcttattgtgccaaatactattaatataaaatctaacaggctaacataaagaaagagatgtcactttatccttagaggtatctccagatgtgggcctgtcatgtggcggggggagtatctgctgagcctcttaagactgtggagatggcagaagcagttttatgcctctgaggtctcagcaaattggcatcagtcacacttacctgtctgtttccttcactgatctcttttaaactatttctaaaccttccccctgtccatatcgtgcctctgtattcgaaatataatattattagacacagaattttacttaaaaatacctactcacaggaaaataatgagactttctcaaagaaagatcattcctatatttttggcaaagggatgggctcctctgggaagcctttcagagagctacattgacacatttgtataaaaataaatgaaacagtattcatcataactacgtgtctcttgcaggattctataactcctaaactaacattctgcagatggcatgccaatgtgttcaagagggatcatatataatttggatagttttgatatattaataggatatatacatcaggctttctttttaaaaagtgaaatatatatgatcttagaggcaaatcaatgacttttatatttttgaaacccctaaattaactttttaagccaaatgaggctattatataatagtcatcattctttaaaagtttctacttccatttcttcccctcctgataagtttattttctcctgtatcacaccactcaaatttctagtaacctcttaacttccaaaaggaataatggtgtgttcctcatgccctgtgacttcctaccaggatttgcttacagtcactatccctgaatggaaactatttttctctgatcccaagatcctaagcagagcattgtgtgtatgttgtactctacttccaaccaaccctttaaagcaccaggcactctgcatgttgcattctggccagagtgcactgctttgaattcctctcatttgactctttgacgatccttactcagtgctcttcttcagcctgtttcgtcagtctgcaattatctttttcttctttacctccagttgaaattttacttctatttcaatatctattttaaatactttctccttctaatgattaccctcacacccacttaagtacacacacttgtacacacactcactacctctctaggtagaaatggttgattcttatcttgaattctgcttgtactctcacgtagcaaattttttcaaacagccaatatataaacttcaattggacttatcgctgtattgaaggcccagattattattttttagaaattggctacattctagaatgcctagaaaaccaaactagattgtatacttaaaaaaattaaattaaatcttaaaagtacatattaatatttctaataattcagctaagaaaaaacactttctctgaatgtagcattttaccattttcctgacatttctattttctaatgtattagaaataaatgttaaaggttttggggggtgataatggcctatgttttaacttcggcttaatgtttattaatgtgttacttctgaaatcaattatttctataattgttaaatatgtctttataatgtctacaattgttaaatatatctttataatttaaaaaatcatatgctgaaagcaaaaccattggcaaaatgaacgcgttggacatttttaaagcatataagaaagaaagaaaggattacagcacaatactagagaccttagtgcttaataaaattctatgtgttttcccacaattccactttaatattaagtgtaattgtaaaatgattctgaagatgtagcaagatgagtgtcaattataggcaaaagccaggaaagggtagcatggaaccttctagttctttcttccactaccacagtacccaatgaagcaatgtgcaacagatggtagaggctccatcaacctgaagcagaatatcctgctgcctacaatacacatagacatatcaacacaaaactttttctttttaaatttttaactgacacgtaatatttatacatatttatgggatacagtgtgatgtttcaatacatgtataaaatatgtaattattagggtaactagcatatctataacctcaaatatttatcatttctttgtggtgagaacattccaaattctcttttctacctatttaaaaatatacactatattattgttaactatagtcacttgactgtacaacagaacactaaacattattcttgctatctcactgtaactttgtacccactggacaacttcttattcccccactcccaaatccctctaggcctctgctagcaactattctactctttacttctagaagatcaacttttgaagattccgtttatgagatcacgtggtatttgtctttctatgcctggcttgtttcacttaacatattgtcctccaggcaatttcgtgttgcctcaaaaaacagaattttaatgttttttttttatggctgcataatattacattgggtaaatataccactttttttttttatccattcttcagttgatggacacttagattccataacttggctattgtgaatagtgctacaataaacataagagttcagatatttcttcatcatatttatttcatttcctgtgaatatatacccagtgctgggattgctatatcatactaaagttcaatttttaattatttgagggatctccatacttttttccaaaatggctgcactaatttacattcccaccaacagtgtgtgaaggttcccctttctcaccacatggcctctccaacatttgttattttttgtcttttgataatagccattgaaggtgaggtgagatggtattttacagtggtttgtttgcttgttttgagacagggtctcactctgtcacccaggctggaatacagtggtgccatcacagcttattgcagccctgactccatctcaatcaatcctcccccctcagcctcccaagtagctacttactatatacttaatctgtgtgtgtgtgtgtatgtgtatatatatgtgtgtgcctgtgtgtgtttctcataatgcctttccataatgtaaggaacatattgggaaggtccttggaattacagtaaacacaatacatttaaaagaaaacaacccatttcatagttctagatattatcttttctctttctctttctagttcttggtttattttcttgcctttttagactaaatctctgactcactttttgaagctcctaataatgcaaaaatttcttctgaatttactaatttaacctcttttgttatattcacccacacattatatgcatgtcaccattctctctgtctggaataatctttcccctgatttttgcctggttatgtactactgattcttcagctatcacttgacatgcctttgcgttggaaaacctctgggtcctggacttatatactctctcataatttgcattcttaactctttttattcttaacaaaattgaaaattaaattattttttatatttaataaggcatttctgtatccaccattaagccatatgctacctaaagacaagcaccatgtgtcattatctctgacatatcttgtcacaggcaagcacagtgctatgatgagaacataatagatacacaaaagcatgtgatggataactgcagtaacttataatcaactattttgaaaatggtatttctaggctaatcatacttagcatcattgtatcaatttgtatgttcatcttaatattcactaattttgatcattttttcaaaacacatttctattctatagctttcacttttcatagttaatttaaagttttctaaaaaatgaacattttcataactttaaaaaaagcctttatcaattattctaacagcattcagagtaaaaggcaacttaatttgattgattaattttggatttagttaagttagaagttgccaaattataatatagtatataactgaattttatatatgttagatatttacaaattatgcattgaattcaagttttaatatttaacatctggtaacttttatgaaacagatattttattactatatttcaaagtttcctgttttattgcattttatttacttgaaataaataaacaactgaaatacaggatgaagataacaacaaaactcacagctaacatttatcatgagcaggtataggataagtgattgacatatgctatcttatgtaaccctcacaaccacccagaggggtaaacgccactattctcatttagacatgaggaaactatagtcataactaggtatccagttctaaaaaaggagcttaactcaaatgcttgaggccctgccatgatgcaccactacttcattgcattaaacacagtttaaaattaaactacacatatccttaaaatttatctgtgggagcaggagaaataaaactaagaagaatggttggttttattaaaatccctttcctaatgtcattgagcagtacaacatgtttataattaaaatgaatgaaacttaacattggctttattcttttgtgattcctgcacgtagcatccttctctaccacatagcacaacattatggacaacagcatgagaaccatctttaattctgcctcctgtttccagtaactccagcaataggagtcaatgttgaagataatatgtaaataaatcactaataattcagcattacccctaggtgggctagggaagagcataaattatttcaatgtacagtccagtaaatcctttgtttttggtctctgatgcgtaaccattaaagatgcaccttattaagaaattcttatgtaacatttctagacataaatgtcatctgtctttccaaaactgtcttttaaaacaaactcctattcagctatctttacatagttgagtagtataggacatttgttaaacataaatggaaaaaaccatattcttcagaaacaaaatattattcatattagaagatcaaatggagactttttgcttctctataatattttattacttctctgtttttcttctgatacttcgggcgaaactggtgcaagctaagagttgaaaatcaatgccttagggcatgggcttttaataccactacatattagaatcaccttgaaatagtaaatacatgaaagctgacagcccacctcagaacatttaagttataattggatggggccagaatgtttagagtttgaaaagtttcaaggtgtctctcatatgcatacactattgaaaactactcttaagaggtaagaaacctaaacaaataaagtctattcttaaaattcaatttttctacttactctcccatagcaaattcatgtatttcccacgatattatttttttattctccccatataccttacaaagaggtcattagtactctaattatattttgtccttctctttaggaagtgtttctgtcaggtattatgattattttactttataattataatgcaataatattttgcattaaaaattaattaacacatagaatgtaccaggtattgttccaaaaaacttttccaatactgagtctacagcactattgctatcttcatttcacaaacaaggaacttggagcatagagaaggtcaaataacttgactaaaaatcagtcagctgttaggtagcatagacatgatacaaccccagagcagcatggtgcttcactaataataacaaaataatgagttgatagttatatagcaattagaacagctctggcaagtgttaggttattgcttactttactattatcattatgatcattattattattatttactgtgtgattaccatgtgctaggcataatgctaagaactttacatagttacatggttgtatatgctttatttcattttcacctcacaatatccctgtgagatgagaacacttattgctgtaagcaacttgtttcagtcacccaaccaataagcagatgagcctgaacaaaaacccatagttaaaaccatggcgtttttctttttcattttgtatcctgtacaggatttaataatagttttctcaaacagtagtaaactattatttactgaattgaattaaattgaatttgtatatctatgattcaaacttagttacattactttgcagtagagacattttcctttttttatatatatttgtgtctgtcttatttaatatctcttagcctgacgttcttaaaaaatatcagtttatcagatgagtagattgcaaaaattttctcccattctgtaggttgcctgttcattctgatggtagtttcttttgctgtgcagaagctctttggtttaattagattccctttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaatcctttccccatttcttgttttggtcaggtttgccaaagatcaggtggttgtagatgtgtggtattatttctgagggctctgttctgttccattggtctgtatctctgttttggtaccagtaccatgctgttttggttagtgtagccttgtagtatagtttgataaactggattaagaaaatgtggcacatatacaccatggaatactattcagccataaaaaaacgatgagttcatgtcctttgtagggacatggatgaagctggaaaccatcattctcagcaaactatcgcaagaacaaaaaaccaaacaccacatgttctcactcataggtgggaactgaacaatgagaacacatggacacagcaaggggaatatcacacactgggtcctgttgtgtggtaggtggacaggggagggatagcattaggagatatacctaatgtaaatgacaagttaatgggtgcagcacaccaacatggaacatgtatacatatgtaacaaacctgcacgttgtgcacatgtaccctagaacttaaagtataattaaaaaaaaaaaaaatccatcattcacataaccttaagccaatgacctccacaagcttcactttccttatctgtaaattcagataatggtacttacttcacaggaccatttggaatctaaggagttaatgcatgtaaaatacctaggacataaagcgtcaataaaacagctcttttatctcaaaaaaaaaaaaatcagtttagttaaataacggtttatctctttgggaaatgtaagagagaaaacagtctagaattgcgacatcactgtcttttcaccaaatacagaatatgggtgtggtaggcagcttctaaggtgaccgccaatgatctctgactcttggtattcctactgttgagtctggattggatttaaagacttgtttttaatgaatggaaaatatcagaaataatgggatattacttttgagattaagttataaaaagaaagtatcttcagccttgagctctgagtgttgctatttctctcttcaaccccctatctcagtggaaaaacagcctattgcgagcacccctatgaggagagaggtccatctgaagatgaattgatatctctcatcaacagccggtaaaattctgaggcctgcctatagctacatgagtgagtgtgaaagagcgtcttttgaggcctactgtcagtccctttgacaagttttggggtggattatcttccaattcagctttaagatgactgtggctaaataacatcttggataagctgattcacttcggtgtccttagagaccttgagccagaggaacaaaactgaactacattcacaattgtgagataagttttttcttaagacacttcatttggggataaatttttatgcagcaatagataactaataattatattttggttatgtgatatatgtgaattcattttggaatcttcacataaacttcaaacagatagatatgtatgcagctagaaccaaataaaaacaaaggcctacattactgaatattgggaaagatgtgatttttatgtaaatgcaacatatgtgcagataacaaaaatgtgaccaatatgaatcctgaaatgaaagacaggagcaggcactatgaattactggttttcatgtacagtgaggcttctgtcacagaccaattctccacagcatattctaggttaaatgcaggaagaatttttttttttaagtaaaggtgcttgataattctccttattaatgccaaatatgtcagtaggctttccacaaaaaaataaggaatggtacatcattttcttactttttatttataaaactagaaatattcattacaattataaaaattgatttggataacaaagcatttaaaattgatatggatgaaaaagcattgttaatatcttattctaagtatttagtgggatgataagatttttgtttcagtagttctaacagaaccaagtcattaattagggaaatgatagtccttcaaggacatcattagaatgatgagcttctgctttcaacaaagagagaagccagagaaccgaagtaactcaaatttgatacagattcacaaaggatcagaagttcaaaacatactaatgcatatgaacattatattagagaccactgcatcccaaactggtattttacctaataatatataagcagttataatatttttaaaaatgattcctgctcaaataagtttgagaaaaaaatgctggttagacaggcttgttaattgtagggctctcctgtgctttaaattactaatacgcacgattaatctctaagagtgaaccaagaaacagcatttcctaccttcatttgagcattgagatttttgtgaaggctaaacaattagcctcgcccagagtaatgttccatggaacaataaatgaggaacactcttaagtatcataattcaaagagttcacagtaagctacaagaaagcaggaaccacctttagccactcccagtgtactcccagtactaagtacagtactgacagtgcaggcttttactaagaaattactgatgaatgaatggatagacacccccaaactgtaagttggaaagtattagctacatgcatatattattttcaattgtagccttgcatcaaataatgatttatttctcttcatctttctaccagcatctcaatgcaaggtcacttcagaagtctggaggcttctataacagcacacaggatcaaaggaaggaccctccactcaagaataatctgtcatgactgcggctaatatcaacattatccaagaccttatttaggttccttgaaagctggtatctgtgcagcttccattcaggtggaaggtactgaaataatcatagactggcaaaaatggccaagcgcagtggctcacacctgtaatcccaatactttgggaggtcaaggcgggcagatcactcgagctcagtagttcgaaaccagcatgggcaacatgggaaaaccctgtctcaactgaaataaaaaagttaactggacatggtggcatgcacctgtagtctcagctgctcaggaagctgaggtgggaggatcatttgagcctgggaagtcaaggctgcagtgagctgtgatccggccactgcactctaaacctggcaacagaacgaaaccttgtcaaaacaaaaacaaaacaaaacaaaacaaacaaacaaacaaacaaactctatttttaagtcctcactgctaaatgcaaaattttctaccacagggtggtagtaatagatttctgttattgagaagaccctcctccccacccaccccccccccaaaaaaaaaaacaaaaacttttctctcctggtatttagtacttccttcttttttttctcttttatcaggaaaactgatatactattttcaatgagttttggattttctaagggcacacacagagagaataactttaggctacttcttgaagatataattcaatgatttttaaccaatatttatgccatccagcatcacctggagtatagccaatcaaacaaagcatatgaaccaagtaatcacacaatatctgcattgatgtgttgcctacatgcagcagaatgatctggatagctcaccaaaaacataattcatatataccttttttactccatttgccaacatactttatttcagagaaattttaaattatatctcagctgtttctcagagctcctttgtggaaattacatcctggtttctgttccatacttgagtagactacaggctttccagtacattgtccattggaccaaaatctggagcaagagaaatagtgttatggtagtcaggacacagtagctggagccaaactatctcagttcaaattttcgctctgtcacttactaagtctttatccttgaacgtattatttaacctctttgcctcattttccacaactgtaatcaaagggagtagtaatagtatgagttagggtcatcacttaaattgagtgtattaatacatgcatcacttagaacaggtgtgtggtgtatatatctatatctatatttatatatctatatctatacaatcatccctcagtatcctcaggggattgggttcaggactgcccgcatataccaaaatccatgcatactcaagtcccgcagtcagccttgtggaaatcatggacaaaaaatgttggccttccatatatgcggatttagcttcctgcaaatactatgtttctatctgattttggcagatgaatgtgaatgaggaacccacctatagtgatggccaactgtaattattgaaaaaaatctgcatataaatggatctgcctagttcaaaccatgttgttcaacggtaaactgtatatctcttctggactctccatttggaaacacatggacccagaggatttcttcctttgcttgtttatttttatgtgagtttgggcccacatttatctctattggctgatccagaagattcacagaggttatgttcttcatcttgctatcccaaccgtcaggtccaagactttgtattatctttttctcttacttcattgacttgtagatgcccctggtccttgatccatctttgtgaacttaatgattcaaactctgttgtttatagcaggtttaaaagaacagctcttattactagatgttcagaaaaatataaattttatgtttctattaaatttagaagattctacccatttttagcattaaaaaatatgaaatgtttattcagataaaaatttagtccaatgtagatagatatacagtgtcttctaggtaaaaatgtttagtctcccagacacctttccttcttagtttttgtctccttaagatagtgcctattcatagggaaggggttggggggataaatggaacttattttataaggtttcatggtggtaggggaagcaaacaaacaaataccttgagtgctatgtcctcagatttctacggtttccaaagaattggttatgtgctgttggcacagaattggttatgtgctgttgacatctgctagtgatcactgctgattctgtatcgagtgtgagtctctcagcttagaaagcatgtaaaagtgatcatgtgatcaagtgatcttcatcaagtggaaggttcacctcagcttccactgcacctgtcacttatgagctctcactataatttcattttccttcatctggggatagcaggtagtgattcctaaccttttgtgcaaagacctctgacttcatacagttctcccagcagcctcttggtaaattctgagtcctattgtaactctggaacccagggtggttccaaaaggctacaacatagggccttttctccctgacctgttgcattgctaagtaattatagctgagcccctagtgattcaagtaaaccttcaagaagaacctcatcccagactcctggactatgggcaagagttttctcctcattgttattccttcaatatatgtaacatacctcatggataaggatggctcttatattcttatataatcctaaattaaatgtcaactattaagtattatctctgacatcatctttatattccctccatccttattctcaagcaaatgaaagctatacaacaacatagggaggtactcagaaatgcaaatgatgaaagcataatgtcccctcgtgaacacgaaaacaagttcctggtaatttacgtgcattttgtggtaccgccaaatcccaatcaggaaaataagtactgtgtattgaaattgtacctctgatttcaaaattaaaacataaaaatttttagtagttatataattatgttagttgcatgaaatttgtttctaaaatatgactttgacaaagatatatataggacacatagtaatcaaaacaaaagtggcaattttctcggtagtactatctaccctcatgggctattctatggaattcctttccctattgttttaggtaagccgtcagtatatctgttttgcaaagaaaacaatgatactgggattttagtacaactcatgtcacttagtttccatgtctatttctttatatgagttattatttccttttaaaactatcatttatgtatcatgatagattcaaaatatatctaaatacacgttgcttattatgaatactaaagttaagtaatgcagaatttatagattcatactccagtttaaaattaggtagcttacataggggcatttatattgtttcatggaagcaagtttattagtgctttcctttcaagcatagcctaaatacattaagattaaatacattaaggttaatttgagagtagttttaattccataggaacatacattagccatatcttttcatctggaaaaaattataacaatagcaaaacaataagtctaataatgtctacaaagaaaccatatgagattagaaatatgaaaccttgtataaatccctcttatcagtccccatacaattgtctgaatccccatggctacagtcaattatgcttttttttcccccacagagataccagcaccaataagagaacagtttattctgcctcttgcagtgatttttgtgaatatctcaaaatatcgataataagaaatgggtcctgtcaatcaatgcatctgatggatgctaattctatccagaaaacaatattaaccttttccactgtaagcctatcaaatactagagatctaagatggaataatagctcaaaatgaatttctccatgaaataaaaatagaactgcttgttaatttttctcgaaacacagattagtaaaactgcagctgtttcaagaagtgaatttgtgggaaaatgtcaagtgtgagacatttttctttcttgaccaattaaaagtaataacatgccaactttgagaataatagtgtgggaaatagtggcagtttttaaactttgtaaatagaaatatcaaaacatataattagtttcaaatttttggttaattaaacacaaatacctatttatctgttgtattttgctttcatagtgggcttataatgttggtatgaagaaaataaaaatagctttattgttacagcctatgtaacaaagcatgacaaaaacatccagatatctaatttctcattggtctgggtctttcgcagtgtggatgcataattttgttatcaaattgaatggatatttttaaggatataattacatgtttcttggggaagttcaacaatttaaagtatcttgtcaatgttttatattttccattcctccaaaacttaaaattaagtagtgagtcactgattcaacaagatgtacacaaaagtatgtctactagtataaattataaatgtgaaactatagtttagaactctcatcattaaagttattgggttataatagaaacacatgtaatacatgtaaaaatgtataacacaagctcaagttgagttataaaaacatgttttgctcatgaaatttaattttttactaaatttgattagttgaggcttttaaataaacataaacattaatgaattaaataatgtataattccacaaatgttttctccacatgcatcttatgctatggaaaaatatttatccattctttccacaaatatttattgagctttgaaatatgccagacactgttcttggaagcaagaacacatgaataaacaaaaacattctaaatgctggcctttgtggtacttgtgctcatgttttgtatattaaataaaaaagacaaaaactatttttgtgacatttgcagtttgtggttaagcaggcagtaaactcttcttcacacaagtcaacaggggaagcacaggttgtaaatatctgaatgaaagagtgatgtgatacagaataatgtgtgaaggcccattgtagggaagagacagggaagcctttttgaagtgataactccatggcgtgacacacttttaagtttgcctaagacagttttaatttacatttgttgtcctaacagtctgtcagagtagcctttgctccactcaaatatttaggagaatgactaaggtaaagtagtagactgattgtaagcattgaagcaggttcggtaagggatggttttgattgggtttagggtgatagtaactgagattcagaaatgtggatacacttgatacaaatactctaaataatcttcttttccattcctgtatttaagtcccttatctattcaaagaataagtagcattcaagactctaaagttcaaataacagaatgatacaccacttcctgctttagaggctcacagcccatctgaaagagacagacaaataaacacatgcatataacttagagctacaggaatcctagtgtaattggcaatgggtaagtggatcaccaatgaaagagaggtgaattctaactatattcaaaaacaaaaaagattcacagagtaatggaccatggacttgagatttagaagtgaatgatggtcatttgtcaattgggataatatctctgtaaggtgtatgaggtcctaactttggtgaatgaaaactacaatttgccttcataaattgcttacattttttctgaagaaagatagttttataattccatctattaatatttctttgaaccccctgttacctgagaaggcaatctattttgaaatgaaaataatagaagcttaatacattaacctggaaacactttataatacatatcacactgaagaggtcctacataagtactcttctgttcattttaaacttgagctttattatctgttttttgtaaaccccagagctttcttaatgagcattatgaaaaatcttttaaataagacaaaaacattttaggtttctattcctttttttccctcagtgctttcaaagaaatttctgagcataacctgttgtataaattatactagcaggttatgattgtttggggtacttccttgatttttcacatttaaaaataaaactgctcatgttttttttgtttgtttcaaacagcaagtagaaaaattgtcatacagaatgttacctgtaaactttatctttgttcatgttttagatttttttccttgatttgaatgacttcttttttcttttcaggtacttatatgtgaattattttcaaactgtactttttaagcaatagatgcggaaaaaataggaatactgacttattatgtcctcaaagtctcctctcaacaaataccaggagatttccagttttctcttacatagtttggttggaattagctctgttttgattaatactcatgaacaatgtgtttgttctgccctcttttttaaatatgggagggagttgatgttggtaattatttattatttctctcaactttgctataaaacaggaggaatttcattcaacttccgatcacatttgaattagataccagaagactaataataagtaattttacaatgttgatgtgcgggcaattctagggaagactcaaaacccagaatacataaaagggaaaattcacacgattaattacgtttaaaaattcacatggaaacacattaaagagttcaaaagagaaaagggaaaagtaaagccatgaaatacaaactatccacatgagtactaaaataccaaggtgtaggttatacatgtttatatatttgtcaaaatttggaatgtacacttaaggtttgtgcattttattatatgtaaattttacattaaaataaataaatttgaactctagttaatgatagtaataataaggtatttaagcgaaagtacgctgattcctgcaaagtattttaaattgcatccaaaaataaggtagaataatgtatggataggatgaaggaaatatggattgtttgtgccacgagtttaaataaatattagtgttagaatctaggtggtagatcaatgatgttcattgtaaaagacctttaaattcactgccccctttttttttttttttttttgagacagggtcttgctctgtcacataggctggagtgcagtggcacaatcatgactcactgcagcctcaatttcccaggcttaagctagtctcccaccttagtttcctgaatagttgggactaaacatatggccgaccatgcccagctatttttttttttttttgtagagacgggggtctcactatttttcccaggctggtcttgaactcctggactcaagcaatcctcctgccttggcctcccaaattgctgagattacaggcatgagtcaccatactggctttcactgcacatttgaaattttcataataaaatgttgaaaaatttctacaggatgatttctaataaataatataatgcaattgaataccaattaaaaattgcattgacatgaatggtatcaacaaaaaatttaaaataaacacacaagtgaaaaaaatgaaaataatgcataacttcattgtcgatcacatttataaattaaaattaaattgatatttattctattatgtcttgaaagaagaaaataaattataatacacaaggtttttgagtgtgagggtgttgagaattatatacaatgtccacgtgcatataaatttgtacagccttttagaaatactccttttgaatatatgtctaataaatttaatgacattacctttgattcagcaattcaaattttagaaatgtattttcataaaacattgaaagactggatgcaaagatatatatccataagtttatagttatcaaattgaaagtatataacatacatatttagcaaaattatttgattaaatacatttggtataaataatatgattaaaattttttattgtattgtaagcactgatatagatttatatttatggacataaaaagatagccacacttttttgagtgaaaaaggcaagctatgaaaaattatgttgaataaatatgtgtgtgtatgtgtgtatatatttatatatgattgtatgcataaaagaataaacgtctgaaaatgtagaataaaataaaatttgctatctctggaaatgctatattgtggtcaatgtttactttccttttatacatttccttttacacatttcagtagtttgaaaagtaaaaataaacatttacagataaaaacttgaggaaatatttcacatcagatataatgaataattaatattcttaaagtactgagttcttacagttaaaaactaccaatagtcgcaaatttttaaaaacaatatttatttacatgacaaaatggtagtctctaggaaacacagagaataagaaatatagagaataagtattccttaccttccacatatttacaaccagtattcaaaaatagttttaaaaatatgtttaaccactctaaatgtacattaatattctatacacacaaatgtgaaatgatcacatcaaagtaaaactatttattgctttatatttacttactacatattccaagccatactaaaatgtatttaaaatgtaattctaattgcctaaagaaagcatacgagtttgtataaataaaataccattttcgtaaaatgaaattctaagataaatttgaattttgtttttttgaaaaggattataaataacatttagattatatcatcattcatgagttcaaagaagaaatgaaatctcctttgaatgtcgcaccattctgccctgattagatcaattttggacaatgacaatcgtaattaattactcttagccttcaggatgatgcacaactcaaaatacggaaaactgaaattctataacaaatacaactggctttacaacatctgaacaatttaatacatttaaaattacttaaatgaaaagtaaaagttaaagttattgactcaaaattttaatcagcttgactatccttctgcatctaaacatgaattaaacaatcttaaagctagaaatctaaccacagacagatataagtaaaaaagagaagtttaccagtttacttttttctaatatctgagttgaattagtctcttccaaagtattttttttttgcaattttgaatttactagttattttaatgaatgaagaaataataatgggatataatgtcttaagcaggagtgagtagaatatacaaaaatctaatctaagaatgggaatgagatattggatatttatttatgaaaactgaataactaataaaaatgatctcagcaaatatgcttaatttagatattgtgataatttcttgtgaaacttttgaagttaatgttttgagggaactttaaattctctctcaaccacttgcaatttaattaattagctatcaggcatcagtgatattcaaacttgcctccagaatctcatttatgagatttcaccctggatcacatttttagtttgtcataaaggttggcactctgcacaaaattggcaaggcaaaatatttattttcctctgtattcacttaaaaaaaaatactgtcacatctgacagaaaccatagtaacttctctctaaagttattctttctcaagttttttaccctttgtgctcttgacaacttttctgcaaatttcattgtaacagaaccaatacaattaataagattcctgctgtaactttcctcacgccttctatttatttttgtctgtttattaaaatagtactttttataagagtcgccctatgatattactgcttcttttaattactttttgaaaaataaatacttttatttttaagaagtatgtttaatcaaactcatcttaaatttattttgcgtaccttcaaatatgcagttatctgagataattaatgttttaatatggccaaacaaaatttgtgctttaaagtccattatctcagcgaacagaatggagtgaaaataaattatatttaaaaccacacacatacattatgcagaattttctcctttcagaattgatattcacagaaataaaatgccactcttattgtttagttggaaaatacaattgttagaaaattacatttcatcttatgtgtcaatctctgcagagaaaagcaaattagctttccctggaatgtgagaaagcagcaaaagcaaaacactctaaaattataatttcatattcttatatttttatctttatcttgctaaagaataagaatatattccactcttaaaaattcttgattttgtggaggaaacacattcagcaatctttagaatgatatagataagtgtcacttaattatgaggatacattctgagaaatgtatcattaggcaattttgttattgtgtgaacatcacagagtgtacttacagaaacctaaatgggatagcctcctacacacctagactatatgctatagcctattgctcctaggctacaaacctgtatgaggtactactgtacagaatactggagacaactgtatcacatggtaagtatttcaatatatttaaacaggaaaaggtatggtaaaaatacagtttaaaagacttaaaatggtacactgtatagggcacttgccacaaatagaatttgcaggactgaaagttgctctgggtgagtcagtgagtgagtgctgagtgaatgtggaggcctaggatgttacactattgtatacttcacaaacactgtacactttataaacagtgtacactttataaacactgtacacttaggctacactacatttactaaaaatatatttcattttttcaatgataaattaactcaccataacattttaggtttatttactttttatttactctttgacttttctgtaataacacttaggttaaaacacaaaaacattccacaaccgtaaaaaatatgttcttgctttatatccctattatagaagctttttcctttatatccttactatataagctttttataaaaattttaaaagatttattttcgtttgtagtttctaaactttcttgttaaaaactaagatacaaacacacatattagtctatgcctacaaagtgtcaagatcatcaatatcactgcccttcacctccacattttgtcccacagaaaggtcttcagaggaaataacacacatggagctgttatctcctatgataataatgccttcttctggaatacctcctgaaaggcctacctgaggctgtttcacagttaaatcttttttaataagtagaaagaatacaatctaaaataatgattaaaaacatagtatagtaaatacacaaatcaataacataatcttttattataaagtagcacataattatatttgcttatattttttgtatgactggcagagcagtaggtttgttttcaccatcatcaccacaagcatgtgactaatgcattgcactactacattaccatgactaccaccactaagagataggaattttccagctctattattatcttataggaccaccttagtatatgtggtccatccttgactgaaacaactttacctggtgtacaactgtacgtatccaagatagccaaaaaaaaaaaaaatctaatactaacattgtaagaactgtataaaatttaattttaaaattacatgaatcttttaaaatagagaatgtacccttgttactcctaatacttagctgactctcctttttctagatgagaaaaatatcatcacaattgcaaatcatcttaaaaggagattctcattcagtataatataatttcacttacactgaatatcactttttatttcctttattgcattatctcacatttgaaaggtttgaattgccacctggcagtgtattataatatcatattttacattcactctttatcagatatctaacatggaaattcaagttcatatttctttgcagacaaaaccaatgacaaaaagttctttaaacaatcagtttctccaaagctattctaaatacatttaatcctctgaatcaaatgcataatatgaatatgtatcatgttcataagcaagttacataaaactaaattgttatgccactaaaaatatataggccacatatcatgtgtctacacttatctttttgaatgcattgtgtttcaccttttgagatatagttcacacactggttataaaaatatccagcccaggctggaatgcaatggtgcaattttaggtcattgcagccttgaactcctgggctcaagtatcctttcgaatcagcctccctagcagttgggactacaggtgcatgccaccacgcctggctagttttttcattttttttattttttgtagagacagtatcttactaagttgtccagacttgaagcaaactcaggccacaagtgaacctttccccttagactcccaaaacactgggattacaaatatgagctgccatgcccggcctattaaactattccttatttgttggtggtttttcttttttggtttctttgtattgtgttgttctttttttcccccttttttaactattcttaacatatcagagtttgtctactcagatttgcatgacctcaaactcatagggattatttatcttcattagtcattaattgctaacaatgaaatctaaattggtgagggcagaaaaggatacgcagataaattttgttccatcatttagatacatttttatgtttatattttcctattatgatacttttaggtttctggagctgcagaacctttgtcaaaaggtgcattttttcattgcaaatattctaacctatgtgccataactacaggggaacatcctatatataaagcaaattattctattcaaatttgacacatgtcctctgtctctgacaatatttcaaagtcttcctaactgtactttatttaaaacttctataacttttctagttttattaacggattaattttcacaggatgatatgatgcttgcaatattcagcttccttatgatcaaagccaattctaattctgctatttactcacaagcatactaattactttttaaaatatcgtgtttataatgatcaaaatatctctctgtgtaactgattctttttcctagcaaaaagctcattagtagtcataggactcaataatgttaatattcccaggatgaatgatacaaaagattcattatctttatgccacactggaatcattgaactgaatcattttatacgattacaattatctttcaggcaatgtactcatataaatttaactaaatgcttaaatggcctgttgacccaaagggcactattagttttggcttgataatttaataaattaatgcccaggaaataatacatactttttattccacacttttctcttttattttttgaatcaaataaccgtgtgggtataattagaatattgaaaaaaaaaaagcttcctttcttcttggctacccttccttggtatatgcatgtcttcttcactgattatgatgaagaactgagagaattcaacctacataagttcattttctgtataattgcaatttaaaactttaagcagcatgcttccaaccagttttggtgaaactctaagaacataaataaattatttgaaaagtcagtataaagtataccttcagtatgaatataatatgggtatataagaaagactatttcttgttttctcatgaaatcctaattttcttagttttatgtttagttttctttttatagataaattccttaaagccctaagtcatgacaagcagaaaaagactgaaaagatttcgaattaaaattattttattgtaaaaattatattgattgatcagagacagttaaatattatatttacaaattccaatctgtttaaatgtcctattagtacacataaagttgtaatagtatggcatttgcgatttatcgcaagatttctatacctttacagtacagttctctgacattggctgcacacagcaatttcccatagagctttaaaaaatactaataaaagggcctcaaacccactacttctggcttaattggcctaggatgttgcctcatcatcaggatcgttaaaagatccccaagaagttctattcttgagccaagcttaggaaacattgctcaaaaggtatatcaacagaagaataaagtctaaagtgcaaagtagacatttgctttaaacttgtcacatttctcaaaatttatctagtaatatagaaaacattatttgcatatataagccatttaaaatggccctaacaatacttattatcttaacaatttcactagcaaagtccaaaagaacactcataatggtataaaaatatattaaattatttagacatagccagcattttagacagctaacaggatgttaaaacaattaatataacggtgcttggattggcatgtgtctttgaatgtaaaccctgtatatatatgtatatatatgatatatatgtgtatatgtatatatcatatatatttattatgtatgacatataatcctgggtattactattttaatcaaaagataattcagagctcatgaaatatgatgaattgaacttccttgatactgattcggattgttgtttggtccatctatctgattactgcttaaagaaaaacacaggtactaaatttaccatgaactgattaaattaggtgatactaaatttattatgcactgactaaactaattcttgcaagctataaactaaattgtatttattaactgcattatggaatagaaatattctcatgaacaaattcctaaccctctggaaaaataatactttattttaaatatttctattgctgagttaactaagcaacaactaaacattctacaatatgaaatgttaatatcatttaattaaaatacattgtggatattggtattacataatcactcattctacagtattaatcatagaagttttcttttcatatattttatagaatgttattaatctttattctggtatgttatttattataacttaaaaaagcaagtgattaaatttaaattaagatagtttatattagttgattgggaaaaaatagaattgctcatcatattttccctccttttaagtattttgttttttttacttattttactttttctggttagaatttcatcaattttatcaaaaatatgaaggctgtttaggtatgaatttttcttgagcattactgtgtaaacaagataaatatataaagaaaataacaatcttaaaacttaaattaacttttttctaaccaccccagaagtctctgtaaatgaaacagctacagaggcatctcagtttatagatggtttttgcttcaactatttccattgcacagatatacacgtctgtcttataactttaattttcttgtctttcttatgaatataacagtacatgcaaaatcacattatttagtgttggagaaatcaatatattaaattagaggtgtctggaatacaatagatgttcagaatattggtatatttgttgactaaattaattttattatttaatacggtggtgacttctccatggataaggtgagagacctagttgaatcctttctatgaatattcttcaagcaatcttgtcaataattcactgttcatcatagtaattatgaacataaaaaggaaaaacatctgcagtgtgggaaatctgaatttgaagtataattttcagtctggtacactgggtaagatcatttttaagtggaaaagaaagaaagaaatggaccctgaaatattctgtgtgtgagcattagcagcaattcaaatacatgatctgattgccagccaaacagaatttatttaaatatgtacacaagtaaatgggtttacatgatttagggtagtttttacaggtactaaaagttagcagataactttgtcttgaatgtaagccatgtgtacaacagaatgtaaggatccaggcaattcgtttaactgagtattgacttttttcaattatgatgaattatgataaagtgattaaaaacacactacctcggtcttcacataatatatgttttcatttgtaatatgatttcctactttgataacttcaaacctaatttttttatgtttttcatatggatggtttatggttattaggtaaaaatatttatttagattatgaaataaaagagcctaaattaataaagttggaaacttttgcatacttttcttaaacaactgaaaaagaagcaatttagttactacaggcaacatggtgtccatgattagtacaaaatttaattattcacaaagtgccaggcacatgggatatacaatacgacgtgtctttaaatttcacttatttcattttccattatctttaggtttatattatttcacagataataactacacatttcataactaaatctgaaatctatacaaatgcacattatgagtgtttttggagatatggacccccaaacagatggtgagatgctgaaaatttagactaccatataaaaattactcttgctacactgtacttcaccaaaatacacaggactagttaacaattacaccctaattaaagaatcttgttgtctggggtcaaagctttaattcatttaatgtccgtatatttggtaaaaatggtaatatgtatggatatctccagaaaagttcaccacctagcaatatctatgcctgtgaaaggatccagaatatgttgcattaaaaaattatatatatgttggatgtagtccaatgaatgtcatgactcagaagaaagtacaataaaccatgttccccatagatgaccagttgtctccacaaaatgtacatttgttataaaatgcataagaatgaactaggtgtacttaaaatggatctacataggtttaatctacttggcaagaaaaacatttatattattagatagagaaagtggttgcatcaattacagcaaataaatgacagtatttgttttttatttgtcattattcttaaatcctctagaggcaaaatggttaatgaaatacttctcagcctgcatttatatgccagccttttaaataaaatctgtaaatattcaaatacaatctatgcatattctgtagtaatctttaaagattatcaataaagttatagacataaacacatacatgcatgtttgtgtgtgcatgtatacacactacaaaggctagtccttgcaaaagatgagaggtatgttctcattgttcattatctattcaaaaccactagcttactgctacactgtgcagaatcaaacaaaactttctagaacataccaaaaggcgaaattcaatcatcgtgtttgctatttcaaaaatctgaaaaatgttgcttagtaacttgtctgcaagtaggttaattgaattcgaataattattttaaaatactttgcaaattactttgtcctttcatttttaattttacatctacattactattgatcaataccttgcttgagacaaagtttagggtactttgcagttttcatcttttgaacaagactggcaagtagtgggtattaaatgagcattggccaatttaaatgaatactctgaggaaaataattcatcccagttatccgaatattcaaaaccgagttcattttatttatttatatatatatatatgtgtgtgtatatataaatatatatatttagtacatatatatgtactctatatattatctatgtagacacaaagctaaatgatgtttactgtgccacatttttactgtcttttggataatatgatttttaattttttaaatattatgttttcttgagaccagatatatatatttgatttttaaagtatgttttcccccagggcatctacacgaatacttctcagatatggttacttagcaaaaaaagttctcagccaggtgcggtggctcacgcctgtaatcccagcactttgggaggccaaggcgggcagatcatgaggtcaggagatcaaagtcaacctggctaacacggtgaaaccctgtctctactaaaaatacaaaaaattagccggtcgtggtggcgggcgcctgcagtcccagctacttgggaggctgaggcgagagaatggcgtgaggccaggaggcggagcatgcagtgagctgagatcgcaccactgcactccagcctgggcgagagagcgagactccatctcaaaaaagaaaaaaaaaagaaagaaaaaaaaattatcaaatagtatgaacacaaattaatttgatgtgaacttcttgacacaaaattgtatcaagagttagaagaacatgttaatgcattagcatcaagcattaaacatttactcttacagtttttcagttttaagtaattaattttattaaattatatattttagtataatggaaggctgatatccaatttttaaagccagcttttattccacatgttttactcatttattctgatgtaatgacatttttctagtgttaatagtcatataaaatgtttctgctctgtgagtttcttcactaattcttgtgtttaagttttctgagtttgttttaattcactcaaaattatttgttcactctctagaaattcattactcttgcaaataatcaaatcactgtttaagacaattaatgtgttaatcaaccttgtttgcttcaaacaacaaacccacaagttagaccaattttaagactaattttattgaaccagagaatttaatatggcattattttcctatatgttttaagaagtaaatctttaggccgggcgcagtggatcacacctgtaatcctagcactttgggaggccgaggtgggtggatcacgaggtcaagagattgagaccatcctggccaaaatggtgaaaccccgtgtctactaaaaatacaaaaatttgctgggtgtggtggcacgtgcctgtactcctagctactcggaaggctgaggcaggagaatagcttgaacccgggaggtcaaggttgcagtgagccgagataacgccactgcactccagcctggtgacagagtgacactctgtctaaaaaaacaaaaaaaaaaagtaagcctttattttctaataaaacgaagaaaaaataaatacgtatatatcttagttcaatatttttaattcaattggtgactgatcactatgactaactaatacattgaagcttttaaaaatgttattatttccctggcttatttatacgaattaagtattgaatatgtgtataaacattaaaacaaataaaaattaaacatcatatgcagttacaacaaatgatttctaacattaggacatggatttttatggaaagggagaaatattttttatactttctttgatcttcagttcaggtgattttaaataatttaatgtgcttgtttctgcacatattcattaaacatcaagagtgttagaaacctatgtataactaagaaatgttgacctggagaaaaaaaatattgtttcacctcttatctatatttgatattaattcagcaggttgacaatataacaagagcctgtgaacgaagctattgatttacttatgagggacttaaaatatctagtttactagtgacagtcagaatgcaaattaatagagaaaaagaaactcacttgttacgacttcaaaaactattctatcattctatcacatatctattggtaaatgtttaatgatacctgaattaaaattacataaaattagcaaggtatattgataaatgtttaatgagacctgaattaaaattatataaaattagcaaaataagttcatatggtattatttataatatattttttaaatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacaatccccagagtgtgatgttccccttcctgtgtccatgtgttctcattgttcaatttccaccaatgagtgagaatatgtggtgtttggttttttgcacttgcaatagtttgctgagaatgatgatttccagcttcatccatgtccctacaaaggacatgaactcatcatttttgatggctgcatagtattccatggtgtatatgtgccacattttcttaatccagtctatcattgttggacatttgggttggttccaagtctttgctattgtgaataatgctgcaataaacatacatgtgcatgtgtgtttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccatatcctctccagcacctgttgtttcctgaatttttaatgatcgccattctaactggtgtgagatggtatcacattgtggttttggtttgcatttctctgacggccagtgatggtgagcattttttcatgtgtttttcggctgcatgaatgtcttcttttgagaagtgtctgttcatgtccttcgcccacttttcgatggggctgtttgtttttttcttgtatatttgtttgagttcattgtagattctggatattagccctttgtcagatgagtaggttgcaaaaattttttcctattttgtaggttgcttgttcactctgatggtagtttcttttgctgtgcagaagctctttagtttaattagatcccatttgtcaattttggcttttgttgccattgcttttggtgttttacatatgaagtccttgcccatgcctatgtcctgaatggtaatgcctaggttttcttctagggtttttacggttttaggtctaatgtataagtctttaatccatcttgaattgatttttatataaggtgtaaggaagggatccagtttcagctttctacatatggctagccagtttcccagcaccatttattaaatagggaatcctttccccattgcttgtttttctcaggtttgtcaaagatcagacagttgtagatatgcggcattatttctgagggctctgttctgttccattgatctatatctctgttttggtaccagtaccatgctgttttggttactgtagtcttgtagtatagtttgaagtcaggtagtgtgatgcctccagcttttttcttttggcttcagattgacttggcgatgcgggctcttttttggttccatatgaactttaaagtagttttttccaatgctgtgaagaaaggcattggtagattgattgggatggcattgaatctgcaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattatgaatgggagttcactcatgatttgcctctctgtttgtctgttattggtgtataagaatgcttgtgatttttgtacattgatcttgtatcctgagactttgctgaagttgtttatcagctttaggagattttgggctgagacaatggggttttccagatatacaatcatgtcatctgcaaacagggacaatttgacttcctcttttcctaattgaataccctttatttccttccactgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttatgttgtgtctctgccaggctttggtatcaggatgatgctggcctcataaaatgagttagagaggattccctctttttctattgattggaatagtttcagaaggaatggtaccagctcctccttgtacctctggtagaattcggctgtgaatccatctggccctggactctttttggttggtaagctattgatcattgccgcaatttcagatcctgttattggtctattcagagattcagcttcttcctggtttagtcttgggagggtgtatgtgtcgaggaattcatccatttcttctagattttctagtttatttgcgtagaggtgtttgtagtattctctgatggtagtttgtatttgtgtgggatcggtggtgatatcccgtttatcattttttattgtgtctatttgattcttctctttttttctttattagtcttgctagcagtctctcaattttgttgatcgtttcaaaaaaccagctcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggcatgttgtgtctttgttctcattggtttcaaagaacatctttatttctgccttcattttgttatgtacccagtagtcattcaggatcaggttgttcagtttccatgtagttgagcagttttgagtgagtttcttaatccggagttctagtttgatagcactgtggtctgagagacagtttgttatcatttctgttcttttacatttgctgaggacagctttacttccaactatgtggtcaattttggaataggtgtggtgtggtgctgaaaaaaatgtatattctgttgatttgaggtggagagttttgtagatatctattaggtctgcttggtgcagagctgagttcaattcctgggtatccatgttgactttctgtctcgttgatctgtctaatgttgacagtggggtgttaaagtctcccactattaatgtgtgggagtctaagtctctttgtaggtcgctcaggacttgctttatgaaacttggtgctcctgtattgggtccatatatatttaggacagttagctcttcttgttgaattgatccctttaccattatgtaatggccttctttgtctcttttgatctttgttggtttaaagtctgttttagcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggaccatttagtccatttacatttaaagttaatattgttatgtgtgaatttgatcctgtcattatgatgttagctggttattttgcttgttagttaatgcagtttcttcctagtctcgatggtctttacattttggcatgattttgcagcggctggtattggttgttcctttccatgtttagcacttccttcaggagctcttttagggcaggcctggtggtaacaaaatctctcagcatttgcttgtctgtaaagtataatttttatttttaaatgtttccttgatgtgtctcttttactgagttctaatatgatgaatcaccaaatacagataatcatagcattcaatgaagagaagttaagtgagttaattaacaggtgtttataaagctgtggtgttatgctttcactaatctttccttgtggcaaatattgtggcacattatagaaaaaataataaaactaaacaaaactaaaaataagcagttcccaagtctccaagcacaagacagagatgtctataaatttaactgaacaacttttccagtttatgtcagcaataaagggatatctaaatggagaccagaatgagacagaatcgtttgtccttctcagctgattctctctggggctcactcttctccccagttggttaatccattgttttcttcacacaggttagacacagaggagaacctttggagatgagaaatttgaactttatatttttcttctttatttctacaggctacactgaaaacagttgctctgtatcaggttagccataagttagagcaccaacttaaattaccttgaaatacatcaactttttataaattttctgatttagagatttcaaaattacttctgctattaatcaaattttccttagacatgttttccattattattgtaatattatcattattaaaataatagtagtagctacattcttttacacattattcaattatggtaagtaatttgcatattttttcttatttaagatctatacaacagttttatgggatggtggtgttaaaattatttttccttggaataataagaataaatatttgggatacctggtttggattactgcattggagaaaaacgtacttcaaagcagactatcattgttaagattgttgcatttcttgagttaatcaagagtaagaccacatttttaatgaatatctcttactatataggaataatctttcttttttttttttttctggttttgaaacagtatctctctgtcacccaggcaggagtacagtggggcagctacagctcattgcagcttcaacctctcgggtccggtggtcctcccaacatcaccctcccaagtagctggaactataagcatgcacaacaccacccgactaattttcaaattattcgtacagctgagatctgtctatgttgcccaggctggtctcaaaatcctgggctcatgtgattctcccacttcagactcccaaagtactgagattgtaggcctgggcctccaagcttggtgattctcctttttaataccttaatttgagatatggccaggcaaacagtagaccttacttctaattacagaattgggaggaaagaaagagtctgagctctgggcacacaagctgatgcagttgatggacaatgtcctgctggataacctccaaagacttggttgtaattttctcaatctccatttttcataggaacctagtagaaagcaggggacagcgaagtcatcatccaggaggaactaacatgaaaaacattttgcatatatattattattttaaaatcatttgccttaatttttaaactgcttatataaaatgaatgtttatcccttgaaatgaactacattaaaatttaatgcagatatttcaggtggcttcagctcaaaataatttgggtaatttttaacagttgtttataataagtaaatttatctttaaaggacagctgagataaataatttttatgaatttacacttacaaatttttagtatagtgttgtgcctaggggaaagtttaatacataataggtattcagtaaaaactttttgaaaaaaaaattgaagcgataaaaggttagcctggatttgccatttaatcagttcagttcagagtcttgagtatgtacatatgaatcattgttaaataaacatggaattattttgtgaattaaaactaatgtatgtacatttcttagatgatgtctaacatgcagtagacgtccagtgagtcacaaatggtgcatagtgtttacttttggaataaagtgagacagaagacaattggtattttctctgtctctcttgtataacctagcataactcacctttcttgaacataggctcatgttgagtgggaagcaagggagtaatcacatggaagaatgttctgctttcaggaattaatgcatcctattcctaaataattaactacaggtaagtatatgatagatggatggatagatagataggcagacaggcagatattctcaaacagcaattaaagtaaacattacaacttaattcaatatctcatattacagttcaagaatctgagaaaatattttctaaaataatgatattaggcatagaagagacacacttagtggctatatagaaatctcaaacttatacaaaagcaataaaagttcccctgatagatatcagtatgggaatgttatgtttacattaaaccctgtattttaaaatgacttagtattggggttggcagttttgcccccttaatcttcaatcccttgatattgcacctatgaatatgtcagcttacatgctaaaagaaactttgcagaggtgatgaagggtatgatgaggagactatcctggattagacagtttcagtctaatcactctagtccttaaaggaggagagccttttttcagctgaattcagaaagatgctgtgatggttaatattgagtgtcagcttgattggatcgaaggatgcaaagtattgttcctgggtgtgtttgtgagggtgttgccaaaggagattaacatttgagttagtgtgcatagggagaggcagacccaccctcaatctgggtgggcatcatctatcagctgccagagcagctagaataaagcaggcaggagaaggtggaagagcagacccgctgagtcttcctgccttcatttttcttctgtgctggatggttcctgctcttgaacaccgaactgcaagttcttcagctttggaccttttggacttacactactgtatgtcaggggctcttgggcctttggccagagactaaagattgcactgttggcttccctacttttcagattttgggacttggactggcttccttgctcctcagctttcagacggcctactgtgggacgtcaccttgtgatcgtgtgagtcaattctccttaataaactcccctttatatacacatctatcctattaatgttgttcctctagtgagccctgaataatacagatgctctggaaaagggagggaggggagaaattcaaagcctgagaaaatttcaacctagaggaagggggctgttatacagggaaagtgggctgcctctagaggctgagaagacctcaagccaattgtcagaaggaaaacagggacctcaatctcaaaatcaaaatgcactgaattctgccagcaatctgagcgagcaaggaaacagattatcttatattccccgaaaagccatggtactctgtcaacatttcgacttcttcctggggagacttggagcagagaaactagctgaaatcaccaaattctgacctcttgaaactgtgagataatctatttgtgttgttttatttcactaaggttgtggcaatttgttatagcaacagaaaactaatgcaggcataatggaggattcagataattacaaatttatccagctttcatttgcttacttttaaatctttccaatatgaacaacaaaaacatgttaattttgtgacttgcctcagttaacaaaaggaaagttctggtgtgaaaatgtcaatataataccgcatattttaggcaaagagaggttgtgaaatagtctcatataattataacatacatgttttctatttttatgtttactgaataaatgaaatttaacgagtttgagttaagtttctgaaaattaaacacaattgcttatatgcaaattgaaaacttgcatcaaactattttgttttgttttatatttgaaattacagtgacaatgatttccatttagctctaaagccattaagcaaggcaaatttctcaagaaaaggttcttaatgtagtccctgaagttaaatgtaacaattgtctatctaaaattgctcttggaattctacatcgcaataatcatttgcaaatgtaatatttttcagttaccaaaactattttatctttactgaactttcctgtggatgttctgaaattattccttcccttcctttaattgcagatttttcaaatgtagcttccagatagcagcttccaggtagcaatcatgatctaaatcactgaagcctgtgtagtgatgtgtatagtctcttagtccctaagaggttccacaaatatcatctcctatacacgttttgaacctcctagacgatgatacaaagcacttatagtcagactattcagtcctgggagatttttgaggtctaaaatctcacagtgattatttggttcttgtatttgtagttcatcaagtcacacagttcatcaaattcatttctggctcagaccttgccatatttaggggctaaaacagagccactacctagagtttgcttgaattctaaggccaagatcatagtctttgttttcttgttgttgttgttatcttctatatgcatttagtaatctcatatcactgggaagtctggaatgtccaaaagcctagatgatgtactgtggaactcacatgatccctctgataagggtgagagtctatacagggatagatacaatgaataaactaaaccttaatccactccctgtataattgaatctgttttaaacaaaccctaattttttaattaaagctcctctgatcattgaaatcaattgtatttgtttacctaaaacaagccatggacccgaataaggagtagattagaatacagaccaggaatggagtaaagaggtcaaaagtgaggaatgactaatttgcaaaataacaaattcaaagatagtaacaaatatcccagcctcaaagttgtaattaataatgataataatagtaataatagatatatattgactatgtgtgtgctcggcagtgttttatgtattgtatggactcataagaacagagagcccctggctcaatggaaatgggcatattatgtaaaaaaaacacacacacacacacacaaaaaactgtcttgttaaaaaccaatatatttcaggttttcttttctttctttctttccttctttcagcctgcctttctttctctctctgccctttctttctttctctttctttctctctttctttcatctctttcctttcccagtttatcttcatataaatattgattacctgaaattggtgctactgtaacaatgacaataaaatgcacagtatttactttaagtctgggcagtaaacagcaagggaactcttactggaggctgtaagaaaggcaatttgtattacgcaagagtgaaacataaaactgtcacttgtgataccatgaaagagagaaaatatcccagtgaacttgtagctttaggtcaaaagttgaacaagtttaacaaagagaatttgtgatggttgcatttgtaatggtactgagaggtgacagcgtgctggcagtcctcacatccctcgctcgctctcggtgcctcctctgcctgggctcccactttggcgacacttgaggagcccttcggccgccgctgcactgtgggagcccctttctgggctggccaaggctggagcccactccctcagcttgcagggaggtgtggagggagaggtgcgagcaggaaccggggctgcctgccgcgcttgcgggccagctggagttccgggtcagctggagttccgggtgggcgtggtcttggcggccccacactcggaacagctggccagccctgctggcaccaggcaatgagggacttagcacccgggccagtggctgcggagagtgaactgggtcccccagcagtgccagcccaccgatgctgcgctcgatttctcaccgagccttagctgccttcccgcggggtagggctcgggacctgcagcccgccatgcctgagcctcccacccactccatgggctcctgtgcgcccgagcctccccagcgagcaccaccccctgctctacggcgcccagtcccatcgaccacccaagggctgaggaatgcgagcgcacggcgcaggactggcaggcagctccacctgcagccccggtgcgggatccactaggtgaagccagctgggctcctgagtctggtggggaggtggagagtctttatatctagctcagggattgtaaacacaccaatcagcaccgtgtgtctagctcaaggtttgtgagtgcaccagtggacactctgtatctagctgctctggtggggccttggagaacctttatgtctagctcagggattgtaaatacaccaatcagcaccctgtgtttagctcaaggtttgtgagtgcaccaatcgacactccgtatctagctgctctggtggggccttggagaacctgtgtgtggaaactctgtatctaactaatctaatggggatgtgaagaacctttgtatctagctcagggattgtaaacgcaccaatcagcaccctgacaaaagaggccactcggctccaccaatcagcaggatgtgggtggggccagataagagaataaaagcaggctgcccaagccagcaatggcaaccccctggggtccccttccacagtgtggaagctttgttctttcgctctttgcaataaatcttgctactgcacactctttgggtccacgctgcttttatgagctgtcacactcaccgcgaagatctgcagcttcactcctgatcccagcaagaccaggagcccaccgggaggaacgaacaactccagacgcgctaccttaagagctgtaacactcaccgcgaaggtctgcagcttcactcctgagccagcaagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccaccaattccagacacagtactataggaaagagatgagcttggaaaataattcaatggttttcatgcaaaaatatgatggcattgtttagaattttaggggtgtgtagggttgaaacacatttttaaccacaaccattaaaaagcaaaattgagaaatgatttgatcagcaaaggtcaatcaaaactcagattcacagtaaagtcaagtgtatgactatcacactcactgttaaaactatacagtagtttaagatgatgctcagtcaatcctttcagttcaacaaatagtgcaaggaaatgagactgaaggtaagcctgttctacagattcctggcaggatcaaggtacccaaaattaaatctaaagggagagtcatatcattaaaagaatagtatgttttataaccagaagttatgacacacacacaaaagacttgaatctttaagggggttattctgaagctgtcatcacagggttaacaagaattctggacagaaatatagttacaagtatgcattagtcaggctgcaatttgattcacttccttgtaaccaaaatcaaagtcactagatatcgaccatttgcatgtccattgttcttctaggtaggatatctgaagttagaatcataagacttttaagaatcctgaattccagcagaacagctgatgccaacccgaaaaccccacatgagaactaaatcagcatgagaatgcagtttcttcttctccctgtctcatgactgcaccctgcactcttcaactaatcaacaatctccacacatcagtccactccaaaacctttaaaaaccctaccctcaaactcctcgagaagacggccttcaggtttcctcctgtctctttgtttggcggccctacaattaaacctccttctctgctgcaacctgatgtcttggtgtattgatttgtcttgtgcatagggcaatgggcaatgaaccttttgaggctataattccactaagtcatccacctctctggaataaaaaataaaatgacctcaatattctaaagatgtaaaacaagcctataaaaaaatcctgcacagcctccagagaagacaaattctcaaattccctctttaagtgaagacaagaaggataatagaaagttaaagaactcccaaaggtcaatcccatggatgatggagaacaaggtacagaactggattgctaatcctaggaagtgaaattagggtctaatcaaggaatacacttccagtgtaaaagcacctcataaattccacacagctggatttcagaattgctgttgaccaatgaccattatatctcctgttcttcccatgtcaaaatggtcactgtggttgtcttgtgtctgcttcactatgtaatatttggtaggggaaaggggatcattgacacttaggtcaataggaatcacatccagacttcatttagagactatcacattacctagattcacggattttagttagatactaagattgcttgggactttgtgttccccccgcctggggaaacaggagaaacaggagaagtaaacagttacaccttatggaacatcttctccattaatattttcttaatagagcatttttctgctttttctatccaaacttagtagaacttacatatttctcaatgtaaatattttgaccaatatttatctaaaaaaatttcaaaaactcaacagcaatattttagcaaaaccggtatatgtgaaagtctcaggttgcataacaaatacatttgacagaacttctaaatcatatgcagatatcttgaaaacttgcagagtatcaacaaaagaaataccattcttatatgaagcacatcacagtgtcattgtcagttaaaatattctctgtgactttgtacttgtgttgaacatcttgccacattactttttatatttctatagtacttgtctaaaatagtaaaacaagtcctccaaacaataaagaaatttgtataaaaattattgagaaaagctgtatcaatggaagaaaacttactgaatgcaaaagaactgcttgttaacaaccgtattgtttggtagttaagaaccaaagatgtaagcaatttatatacttaggcaatagttcataatgtgtattctttaatgcattttaaaaagtaatatattggttgtaaatatttgactgatgtgtaactcattaggaatatttttcatttaaattattaagaaataggctacttgttagtattttcacacataaacctctaattcgcaggaataaattactgtgattaatgggagacccctgtaaaaaagaggatcaaccaagtttttggtgacaatgaagacagatgtgaccattatttgtgctgttgaaaaatatcctcattctccagcccaccttctggacacaaggtagttgcacttcctgaattctgtctggaggatggggctgggtggtgagtttcagtccgtgaggtggggtggaagaatgcatatcatttctggaccaaagtacttaatccactatgatatcctccagtgtgttatttcctccagctactgtgaaaagtaatattagctttggtccttgaatgaggatggcatatacaccagatgggctataatggacacctaacatgaatggaaaaaaaaaaaaaaatcctgtgttgttttccctctgtggggcaagtgggaggtgagttttacttgaaaaatctagtctgatctctgtttctctacaacttcattatgactgaacaagcacaaatactgtcatctctactctgatttactataaaagacttgtaattgatttttctctttcatgttcataatctgcaagtcttctttccatagagggagaataaatttttttaacatgcaaataagattgtgtcagcagttctaatgtgcctatggataattcgagtagagtataagtaaaatttactagtaggtgttccaggaactgtgaggccaaattttagaaagtccattattatggatgttagagttcccaagcataaaagagaataatgaatggaaagaaaggttataattcagttagtggctaaagtcactgaatatgtacaatgtggcagacactctttagttctcacatcactctaattctcttacaacttctcctactttatatatgaggaaatttaatgacagaaagattatggtaaacaatatgtcttaggtaacacaattgttaacgtaatagaagtgggattcaaacttgccacagagcctaacacttaactgccaaaaaccaaaaaaaaatcctgaaagttctatggacagaaccaataaaaagtaggcaaaatgagctcatgaggagtttatgaaagtgcctgttacaatgctgaatgcaaagcaactgcatgctttgtacttatattcttatctggatgctttataggtaccagattttctctgctcgttcatcagtagacagatgaatgttcctgatttccacttgacaagttaatgcattttggaagtgtaaatactcaaataaaattcaaaatcaatgtctaataaaatttttctgagcctggactccaccactagacaacgtatgcatgtaagaaatccgcacttatactcactaactctataaagacaaaaatacaaattttcttctttttcctatagtataaagagctcccttggtgcgggtgagcatgttattattcatgctctatcatattccaaatttcattttatgctacaggttagcatatcaattactatcctcattttccattgaaaggtcagcgttgctgtttgtgtggtttttgagcagaagaaatatgcattctgaacagtgttataaatgtattagttattccttaataacttattatgctacttggatgactataagaatgtaatatataccactaggtaagttatattttctcaagtagaaacaaagaattgaaaaactagaagattatcttatgatacctagtttaacttccatgttccataggtgaagaaattgagtcccaagtaagttaaataactttccctgaatttcagaggatactagtaaatagggataaattgaggaccataactgagggcccttgaatctgtgttccatgtagcttatgtaattaataaaataaaagcctcaatgttacacagcaaatatgtctatctacagaaatttattaaatagtatttttaatagtaaatgagaagtcaaaaaggttggctcatataaagatactatataaagtatttttcttgctaccacaacgtaatcattgcattgttagggttgtgttttctctgaactatccatcataagatttattttttgacttttgtatatctaatgctttctcacttagatcttctagtaattcacatctgagttcactttgctctcaccacttttctaagcagggttaggctacaatggtaacactttaccttcttgcagtgtgctatatttcattttgtaattatatgaaaagacattgtaaaaaagaggaaagaaaagctcaatgtattttacagaatgcattttgtgccaagtctgaagtaccacatacttgtgaataccagagagttttcaaagcattttcattttatttcacattatttcatttaattctcccactaatctgtagaggtaggcgaagtaggttttaatgtctctgttttatagatgagaaaacttgtcattggaaggataagtgacttgcccaagttcacactggtattaagtggtgaagctgtccattattcagtgcttctccctctacagtttactgagataatcagtgttgcttaatagtagctgcctagaatacatctactataattatgaaatacctaccctcaaagccacaaactggcccttttccaatttctcacacttttatagagcagaggtcagcaaactaaagcccacagatcaaattggagtccttcctacttttgtaaataaagtttattaaaacacaaccacagtcattcatttacatattgtctatggctgttttcccgctgcaatggcaaaggtaagtagttgggagaaaggtcacatggtcccaaagtcttcagtgctcttcggcctttgccttgaatgtgtgctgacccctgctagagaatatgaaaagctaaagtatacttccagactcttgcagctattctttcagaaactacagaaatctctaagtaatctttccaggaaatgtttttaaaataaacagacttgactggcttggctcttcttttctttgtccctttcctatatttgcttcttccaacctgtattgtgaacaacacctgggattgcagtcattacttagtatacatgaagagacaaacatatggacaaatgaggacggatagaaagaaaacagagttagggtgcctaactacatttctgagcaacttcttcagccctggacttcgtggatctataaaggattctctacatatgaaatacactgttagtagtgttacttgattataatttaaaaaaattataatggatgcattcaaatgtcctgtcatttactgagtcataacaatagtgttagcttccatgttaaggccactaaatattgaatcactttaggattcagcattttactcctttatctacacccactcccttagcgatcttatataacctcatgaatatacagtgtttatgtgatgattaatcttaattctatcacaaggccagtcatctattcagctagctactcggcaactctacatggaagtttatccatatttcaaacttgacttctgcaaaacctgatcctcttgaagatttccccattccagttaatagcaatttaatgtttcaatgcttgtgccaacaactgtggagtcatccttgatttctctctgtcatctacattccatatttttagcaaatctagtcgtaaccccatcaaaatatttcctgaggccctgcaagctgaagcttagtccttgttatacaggtgagaagaatatgtcagattgccagtgccttcctcttctataactaaaagttctttgagtctaacatctggataaattgtgcccaacattaaacttcatttttcttctgtctctatagaaatgcctcttattaaaaatcaatttgccttcatcacagacagaagcctagaccacctgagatgccatctcctcatattggaaacagctgtttaactgaactgatctagtttcaggactagtctgcagttcatttaagtgctgtgctaaaactgttggtaaggttatcaacatctttgtcacataagcctaggaacactaactgggaaccccatgagtagatgcagataactgcaaagtggttttatttttatttcccttgtgcataacccacctcaaccccacaactatgcctcttgtcaacaggaagaagctagagtgaccatcagccttttcccatctctatagccaacaccttaagagtaaggtgctatggagcccaaagcagggtttaaaactacctttgcaaattatatcagggagaaaattatgacagtaaaagagatctgatttaaccaccccgccccatcttgcctttcccttcaacattcctgagcttaggctaagctaactttgagagacatttagtttatatgacttttatcttattttgttatttttatagagatgaggtctccctatattgcccaggcttgtatcaaactcctggattcaagcaatcctcccaccttggcctcccaaagtacaaggattacaggcacgagccacagcacccattcaatataaaatttagttttaaatgataataggcctcccccaaaactcaaccacctttgtaaatctaatgaaacattatcaggctagggggaagagctaaggtgtggtctgatcacaagatatgcaacatcactatagtatattgcccttttgagatatttgttcaggttttttgcctgtctgacacctggacctgattgctcctatggctccacatggaagcaactccgcttaagaggatagctgtgccctcctacaatttcatctctgcctgaaccaatcagcagcaagtacccattacctggccaccccatcccttccctcaaactgtctttgaaaaactgctaacctaaaagcctgagatgagattgatttgagtaacaaccccatcttctgtgtagtgtggcaggccttgtgtcaattaaacttttcttcagtgcaatgccatggtctttatttatgcagcgggcaggaagaactgatcaagcaattatccttctactcttgtcttatttggcctattctctatacctcagtcagaatgacccagtaaaactgaaaagaagacaaggtcatttctctgcgcaaaatttttcaatgatttgctgtctttcttaaacagaagcgaaaatctttgacaacaacctacaaaatgttttgcagtcagtcccacttcctccccaaccctaccttgttatttccatgacctcaattcatattatagcctctttcattcattgtcctctggctacacttttttgcttgcttgtcttcctgaacatgccaagcattctcctgcctggaagtctactctggttattctttgtttgcattgctcttcaaccaactagctacatggatatctcttctcttgcaaatttctgctcaaatttgattacctcagtgagctcttccttgactattctgtataaaacagccaacaattaaccacttcccttaagatgacagcaagaatgaggaaaataaaaataaaaataaataaaagcataaaagattatccacttctctttcccattagtacttcctatattctctaatcttccattctttatttctatcattaatgttttattatgatatataatttatgtactataatatacactactcttaagtatttgctttttctccttaactcatgtcttctatgacactatatactttacttttatttatttagttatttattttttgaggcaggatctcaattctgtcacccaggctgcagtgcagtggtgtcatcacagctcatcaatgcagcctcaacctcccagcctcaagcaatcctcccacctcagcctcctgaatagctgggactaccagtttacaccaccacagttggatatgttgtttttttaaaaaattttgtagcgatggcatccccctatgttgtgcaggctggtctttaagtcctgggcttaagcgatcctccacctctgcgtctaagattaaaggctaagcttaaaggcatgagccaacacacttggtcacatttatttattatttactatatgtcttcctgaatttaatttaaaaacgataaaggcagaaattttgtttgttttatttgtagagaacccacagattttttagtaagtttctggtgaataatttaatatgcattttctcatttaatcctcacattaatgagttatttcctccacagaaaaaaggaaaaaactcaaatttattatatttaaaataattggcattggtcacattgctagtaactagtgatggaagtgacgaccagtgtggagcagctgctgcaaggatgctggttgcacagcatgagacatggacagggttgcatgttctgcagagctggtgggagccaggagcaggcgagagcccagacccctacttagttgatgaggcagaagcccgtgctccctggcacagctgcagccacccagctgtggcgctggactctagcatcactgcactcttgggggcccaggaagctacttgccatagcaggcttgaaagtacctgctcctgctccctggcctctccccacttccagcacccactctggcatggagcaaagttgtaaccaagcctgggcactgttgcaactctaacaagtgtgcgggcactcgggacagggctgacacaccagctccctgctgcctcagcctcctccagacttcgggcaccaacaagcacaggagggaggctggcgggcgtggtgagtggtgagagcagctcagcatgggcctgcagcacccctcaacacaaacagcctgggcactgtggacagcatgttgatggtggcaagaagcagacaggccctcgggtggaaaggggtgcatcccaggtgaaaccccaccttcaaggcagggatggcctgaagcctgggggccgggttgtcagttccagctggagtccactacccagagtgagaacttacggtgcttttttcgggcctgccaatgacagcccatggacaaataagcgcatatttcctcccttctgagcccactgaaaccctggactcagccagactcagacatatgtcaggactaccagctgtgggaaggaactacccacttcaggtctcctggagtgataaggatgacctgtctgcagaaaggagcgatccactaggggtctcctctgagctgttctgttgctcagtaaagctcctctccaccttgctcaccctccagttgtccgcatacctcatttttttaagaggcaggacaagaagtcaagaccaactgaatggtgggaatgaaagagctgtaacacaaacagggctgaaactccccccgatcgccatgctgtgggcgatgaaaaggagagaagagctgaagaggccctttggggacgccagacctaggggctccccgagccagggccgtgacaccctctttggggctctgtggttcctggcgtctcgaagcttctgggtgccaccgcagtcccctcatccagacacaggtgcccacagtggaagctgcttgtggtacatctgatccagccacagccttacacagagcccgcacctgtgccggtgcctggagctgcccaccgcgctgcagcagccagcatgcctggctgtgcgcagtgggtggaccccacgctcactttctcacatatcccttgccactccatgcctggcttacccttggccggcgtgggatcctagccggtggtgcaagccaagcacagcctggcaggctgactgggcagaacgagccagtgggcccaagcaaaactcaggcaaacgtgccactggccacagaggtttccagctggaaaagcaacaccctaaggaactcaagacagcagtgttgccaagattttaatttagaaattgtgaagtcacacaataccctcttaattaccatgctctatattctcctagctgctctgtagaaaaaagttcagacaaaacaaatagtaacatgattgaaatggagattggcaggatactagaacaagcagatatcaagctacttcagaacaatatcctcttagttgccaaatctaagagaaaaagtaaataagctcataataaaatacagagaacaaaaaacctgagaatgtatgattaagataatatcaatatgagaaaatactacatttaaaactagttgtcagtggaaggaggagtagagaaaggaagagaatagaactctattaagtcaagtttcaggaagaattttccagtctgaataaataagataagttattagggaagtaataaagggtcacttctagaagaataaaaacctgtatatgtttatccattaactcaaaaaaaaattattcaatcctttcatcttgaaagagaaagagatgcatttaataatggattatttaaatgcatctctttctctttccaaggcccaaataatgttatcacaaagtaacaccaacaatgtgaaaacccatagaattgtgactacaaaaattgagatatttcagcacacttttagcggatctaaagtgaatttaagaggtaggaaccatttagtagagccaaaaacgataaaacctgaaattctctagagtaggatgttaatgaatggtgaaagattctgaataaggaagcaaaaattgccatggaaagcagggaatgaggcaagattataaaaacacagaacctgttttttcctcaggactcttatccttacctcaagtacacaggttccgttgctgtttgagatcagtgttttatttgctaaataaatatggagcagaggatccagacttgactccccaggtgtaagagaagagtgaggcacaaagctggaaaaaaagaaataagaaaaattattttatctttcagtttcttctcatcatccctaagctctcccacatcttatggagggatataatcccctcctttcagattagccagtatcctgcctttagctatagtcctacatttattgtctgtgtaattactgagagaaataagatggtaattaactttcaaaatgggcagtatacctgtaacaaagtctttgaaagcaactgacatacaaaaattctacaaataaaagtaagtgtaagctcaaataatacaatagtacattatttatagaataatgcttttcccattccattgtattttaaacctatgaacccaaatgccatactggaaagaaatgttagggaaatgtcagcagtaattcagtgggtccatgaaagggcttcaacttggcaggaaacctctaaaattatatgcaggatcatatttgtattttcatagtgatggttttcatgagagtatctctaaatgaatttcaaaaataattctttcattaaaaagagttttttttttcctttaggaaactttttaatacataggctatccgtgaaatatgtatatgtcttcagttgctgttgaaagcaaaatcagctactcctctgtctgaaaagtattttacttcatcttcattcttgaagggtattttcaaggcatatagaattcaaggttgggagttttgctgttattgttctttctgtgttgttctgggtttttatttggcatgttgagaatatcattttactgttttctgacttttattgctgctattgacaagtcacctttcaacttaatattttctcttgggccattttttaagatttttttatggtgtatttgatgaggtacagtttcattataatgtttctagttgtggatttatttttatttcttttttcctgaaattacttaggatccttgactctatggatttctgtcattgaccatttctgaaaaattatcagccacaattttttttttacccttggccagtaaaatttattatctgtgccctatttctttttttctcctcttaggacttctgttgaaataatgttacattttctcactctgtcctgtatatactttattctcttcctgtattttccttttatttctttgtctcccatgcttgtggtgttttttacagtgtaaacttagcttagctagaaatatgttttccatatgtgcttccctatatgcttccaggttatagtgggccaaaatagaagttggtacatgatttggaaagtggagaggaagcaacagccataacctctgttggttgttttggtgttaggctgtaagaaccagaagcatcaacgctcagagaagcaaattcaaaattaaccatactcttcccaactctgcatttgtaatattcacctgctagccctattgaccaagagtgacctcaggcctactccatctcagatgcaaaggcaataccctgacacagatgtctccactagttctccttaatggtcccattctgcaagtcagccatgcctggtttctgagatctctggcaagttctaatttgtccacccatactggttcttcagagaggaggagagcaaatttttctgatcctctaactcacccattctgacccttacttacccagtgtcttgtgtagttgtctaaagttttagtgctataataaatgtcctattctgtattacttacagtggtagtgctcacatggttgaactttgtctgtactgcgtactgttttactgcactctttttaagaacactaacttcacatccttgtatataattagctatgaggtctatgcaatgaatttttaatttattaaattttggagatctttatgttctttatatccttttttacatctgtagcatcacattttatttccctgtttctgttgatgtccttaacttttgtctttgacttctttaagttaaaaagcttaagagtttcttctgccttgacctcctgggctctagtggtctttctggcctggaattagtcatctcacagagtaatccacgaaaagatttagaaacaactgagctcgaaccaaagcttggaccagttcctaagtaataaataagttctccttgtttaacatcacactagattgtaaagtccttataaaaaatagatttgcttattttatccataactgaatatatagggcctcgaggagttctgagtatctgagaggtactcaatacatatttgttgaataaaagcatggccaaaaaaggataaattattttgtgctctccctgatgatttcaataggatgtacttctgggtctatttattttgttgtttgtgtttcggtgggtacatgcttttggtgtgtttttactttatgtacctggctacctttgatcgagctaagcattacacataattaactgtataattaagcataattaagcactgcataattatttgtaggaataattagaggactgagatgaaggaaagccttcatccagagaggatttctgtttgtttcagtcaacgggggcattacttgtcctcagtcacattcaacaatttgaatacgttagattactgaagcctccagacttttaaaattgggctacaattcttcaagaaagccaatcattttatttttttttattcacctttgtcccaaaggtgtatttattaggtagcaacttattgtgggacacttacctgttagactcttcattttgttctatattttttaactatagataggtcaatacaaatattcacatttatgtaactaacaaatacttctattagttctagttttccctgtgatttcagtctaataagtatttcttttcttacaagacctgcagtgattttaagaagatattttaaaatatatcttacgcagatttttagaagtttttaatagaattgtttgtacaaacaatcctcccattatgggaaacacctagcctccagaaaataactttaagaataatttagagagctttgattaaaaatgtagataggaggcaggactagcttgcagttcctgcttggacagacagagcagtgtgtgaagacttacatcataaaattttgctccaagaactaccacaggaaaataccaggaaagctgagagaattatctgaccctttgaaggaactggattgctactgcaggctccctgagatgccaaaacattgtgagtgtacttgctttctcagcagggatgctggtggtctgaggcaagttctcagccctggtcaccagctgcctaaaaatagactcagtgttgttggggggacacagtgggagtaagactggcctttaggactgtgggctgtgtgggagcagggtgagtcctgcgactgctgactttcccccacttctttggtgacctgtacgactcagcagaggcaacctaatacacctgggaatataactccattggcctgggaaccacattcccattccacacagcagctgcagcaagccccacccaaggagagcctgaactaagacatgcctatccctgctaccacccggtggtctttctctaaccagtgtagttgccaaagaaaaaggacataatctcttgggagctctatggccttgtccactggctgagaaacctgaatacttaaccagacattcctagggcaagtttgcatcctccctatagtaccacagctgatgcactcttgaaagtgccacctcctgcctggagggcaaccaacacaaaaccagtgcactgaacaaaaacacaaccaaagaccctcacagagtccacctcactcccctactatctccaccagagcaggttactggtatccacagctgaaagacctgaagatgaatcacatcagaggactctccagtaccagcccagagctcagtacctctgcttggtggctagatccaaaaaagcgaaaacaatcactgaagttcacctctcaagaagccctatccctagggggagggggtacaagaataccacatcaagggagcacgcggtgggacaaaaaaatctgaacagcagctcttgagtcccagatcttccctctgacatagtctacccaatgagaagaaaacataaaaacaattctggtaacatgacaaaacaaggttttttaacacccttaaaagatcataccagctcactagcaatggatccaaaccaagatgaaatctctgaattgccagaaaaaaattcagaaggttgattattaagctcatcaatgaggcatcagagtaaagtgaaatccaacttgaaatcaaaaacatgatacaggttattaaagaaaaaaccttcagtgaaatagatagcataaataaaaacaatcacaacttatagaaagaaggatacacttagagaaatccaaagtgtactggaaagtctcagcaatagaatagaacaagcaaaagaaagaacttcagagcttgaagacaaggctttcaaattaacccaatccatcaaagacaaaaaagtaataaataaatgaacaaagcctacaaaaagtttgggactatgttaagcattcaaacctaagaataattggtgtttccgtggaagaagagaaatcaaaaagtttggaaaacatacctgagagaacaatcaaagacaacatccccagccttgctagagatctagacatccaaatacaaaacactcaaagaacacctgggaaattcatcgcaaaaagatcattgcctaggcacatagtcattaggttatctgaagtcaagacaaaggaaagaatcttaacagcagtgaggcaaaagcatcacgtaacctataaagaaaaacctatcagattaacagcagatttctcagcagaaatcctgcaagccagaagagattgggggtcctatttttagcctccttaaacaaaacaattatcagccgagaattttgtatccactgaaataagctttataaatgaaggaaagatacagtcttttccagtcaaacaaaagctgtgagaattcgccactaccaagccagcactacaagaaccgctaaaaggagtgataagacttcaaaataaaccaaaatagaacctccttaaagcataaatctcacaggacttatataacaataacacaatgaaacaaacaaggtattcaggcaacaaatagcatgatgaataggataataatacctcacatctcagtactaatgttgaaaatgaactaatatagggactttagcactccactgacagcactagacaggtcattaagatacaaagtcaacaaagaaacaatggacttagactataccctacagcaaatggatttaatagatatttacagaacattctacccaacaactgcaggatatacattctgttcatcagcatatggaacattctacaagataaaccatatgataggccacaaataagtctcagtaaatttaagaaaatcaaaattatataaagtactctctcagaccacagtggaataaaactagaaatcaactccaaaaggaaccttcaaaaccatgcaaatacatggaaattaaataaactgttcctgattgatcagcagtcaacaataaagtgaagatggatattaaaaacgttttgaactgaataatagtgacacaacctatctaaccctctgggatacggcaaaagtggtgctaagaggaatgttcataggattcaatgcctatatcaaaaagtctaaaagggcacaaatagacaatctaaggtcacacctcatggaaccagagaaacaagaaccatacaaactcaaacagagcagaagaaaataaataatgaatataagatcagaactaaatgaaactgaaacaaaaaaactacaaaagataatgaaacaaaaagctagttatttgaaaagagaaataaaattgataggctgttagtgagattaaccaagaaaagaagagagaagtttgaagtatgctcaattagagatgaaatgggagatattactattgataccacagaaatacaaaagattattcaagtctactacgaacacctttatgcacataaactagaaaacctagaggagatggttaaattcctggaaagaaacaactctcctagaatataccaggaagataaagaaactctgaacaaaccaataacaagcagcgagattgaaatggtaataaaaaaaattcccagctaaaaaaagtgcggaatcagatggattcacagctgaattccttcagacattcaaagaagaattcaaacgaattctactgatactattccacaaagtaaagaaagacggaatcctccctaaatcattctataaagccagtatcaccctaataccaaaaccagagaaggacatcacaactacaacaagaacaaaaaaactgcagaccaatatccctgttgagcacaaggacaaaatactagctaatgaaatgcaacatcatattaaaaagataatccactatgatcaagtgggtttataccagggatgcagggatggtttaatatctgcaagtcaataaatgtgatacccaacataaacagaattaaaaacgaaagtcacatgattatatcaatagatgcagacaaagcatttgataaaatacagcatcctttatgaataaaaccttcaacaaaagtggaatagaagggacataccttaaggtaataaaaaccatctatgacatacccacagccaacattatactgcatgggaagaagctgaatgcattccttctgagaaccagaacacgactagcatgcccactttcaccacttctattcaacacagtacttgaagttctagctagagcaatcagaccagaaagagataaaagacatccaatttggtaaagaggaagtcaaactgtcactgtctgctgatatgatcgtatacctagaaaaccctaaagacttatctaaaaagctcctagaactgatgaatgactcagcaaagtttcaggatacaaaattaatgtacacaaatcagtagctttgctatacaccagcagcgaccaagctaagaatcaaattaagaaccacttttacaataacagcataaaaaataaaatacttcaaaaaatacctaaccaagaagatgaaagacctctgcaaggaaaactacaaaacactactgaaagaaatcacagacgatacaaacaaatggaaacacattccatgctcatctcatgggtagaatcgaaatcatgaaaatgaccatactgccaaaagcaacctacaaattaaatgcaatgctcattaaaataccaccatcattcttcacagaactagaaaaaacaatctgaaaaatttatacggaactaaaacagaggccatatagctaaagccagactaagcaaaaagaataaatctgcaggtatcacattacctgacttcacactatactataaagccatagtcaccaaaacagcatggtacaggtataaaaataggcacatagaccaatggaacagaatatataaccctgaaataaagccaaatatttacagccaactgatctttgacaaagcaaacaaaaacataaagtggggaaaggacaaactattctacaaatgatgctgggataattggcaagccacatgtagaagaatgaagctggatcctcatctctcaccttatataaaaatcaactcaagatgcatcaaagtcttaaatgtaagacctgaaaccataaagattctagaatataacatcagaaaaaccattgcagacattggctttgccaaagagttcatgactaagaactcaaaagcaaatgccacaaaaacaaagatattgtaaatagatgggagttaattaaccaaaaagcttttgctcaacaagataaataattagcagagttaacagacaacccagtaattgggggtaaattttcacaatttatatatccaacaaaggactaatatgcagaatctacaaagaactcaaacaaatcagtgagaaacaaacaaaaaaacaaacaaaatcttagcaaaatgtgggctaaggacatgaaaagacaatcctcaaaaaaagatatacaaatggccagcaaacatatagaacaatgcgtaacatcactaattatcaggaaaatacaaatcaaaaccacgatgtgctaccatcttactgctgcaagaatggccaaaataaaataaaaaataatagatcttggcgtggatgtggtgaaaaggaaacacttttacactgttggtgggaatgtaaactaatacgaccactatggaaaacaatgtggagattccttaaagaattaaaagtagatctaccatttgatcacgcaattccattactaggtatctacccagaggaaaataagtcattataacaaaaagatacttgcacgcacatgtttatagcagcagaatctgcaattgcaaaaaatggaatgaacccaaatgtccatcaatcaatgagtggataaagaaaatatatgtgtgtgtgtgtgtgtgtgtgtgtgtgtgtgtgtgtataccatagaatactacacagccataaaaaggaatgaaataatggtatttgcagcaacctggatggtattggagactattattctaagtgaagtaactcaggaatggaaagccaaacatcgtatgttctcattcatatgtgggaacagagctatgaggacacaaaggcataagaatgatacaatagactttggggacttgggagaaatggtgggagggtcgtgaggagtaaaagagtacacattgggtacattgtacactgcttgggtgatgggtgcaccaaaatctcagaaatcaccattagagtacttattcatataaccaaacaccacctgttccccaaacacctattgaaataaaaaaaaaatcaatttataaaacaaacagagaaaagggaagaaaaaagaaaacaaccttcattcacatttaactgaaattggtggctgaacaacgcactattccacctaggcttttacacatgtaagaaagggaacaaaagatttttaaaaagtgtccaggcctggtggctcatgcctgtaatcccagcactttgggaggctgaggagaaggtagatcacggggtcaggagatagagaccatcctggctaacatgctgataccccatctctactaaaaatacaaaaaattagctgggcatggtggcacacacctgtagtctcagctactcgggaggctgaggcaggagaatcacttgaacctgggaggccagtgagctgagatcgcgccactgcactccagcctgtgcgacagagcgagactctgtctcaaaaaaaaaaaaaaaaaaaaaggaaaaaagaaaaacttaaacaataaaaattgacattacttgcaagacccaactattttctatgatttcctttattctagcaagagttttgtatgtgttttgttttgtttgttttgttttcaagattggacgccttttcaaagaccttaacctatgtgtttgtgcataatgtgtatagcataggttcttttctgaaagtgtgtccaatcttaaaacacacacacacacacatacacacatccatgtgcatttgtaataactgaaactaaaagaagctgattactaagaatataatgaaccttattgtttactcttcatcaaacatataatcatcaaatatccatttaaattataaataaaaataagtgatttcataagataagtttgatgccagaaacgaggattgaactggtttgatccatgaaatgctgatacatgcaaaatagaactccatttgtaatttctttaaagtaatactccattcttttttattagaccattgatgagttcgctcctttctctagatcagaactatttagattgtttttttacaaattcagtatgaaggaatttgttttttaataggtgtgaatagcatcgatgtaatgatgtgtcattgagccccacatttctgtcactagagtggtaaaatgacacagaggatgaaccaaaagtcacctgtagatgacaatgggtgaaagaaaacacatttaatttacatagaaacatacagaatgtcaaaagagttaaaattcatgaataaaatttcattaaaaatgcattctaaaatattagttaaatatacactacttaagaatgatttaaaactagcattaaatgtattaaaatggatatattttgcaggaaaaggatgcctgtgttttcagtgttttatctgaattatttaatggtttacaaaactttctgtgaatgaagggaaagcagttttttatctgagtattctcagtgttatctgagcattctcattgcctacataacttattctgaatgaaggcaggcaaaatagagagaaaagactgagtatctataccatataatactttaaatagaaaacattagccctttgttacatatctataggctgaataagaactcaaacacagctcttccaactcaacacacaatgctctctttgaggtctgaaggttataaggctatactcataacagattctcagtctcacaattaaactaaaatctaggcttgaagagattaacactatttagcatgccaggctgggttgtaacacagtagccatatatttattttatttcattttgattttagacctgcagtgtattgccagaccccaggtgagtttgaaatattgcaatggttatttcagaatactttgtgtggctttactgtcatttatgttaaaggtaaacaggattctctgctcgatcattgacatcaaaggcaaaaacgaatgataaattattttccctctattcttgcattttgagacaatttttgttgaagttcaaatttacaagcgtttcgggaggatgttttcttctggggaaacaacattcacagcagtccagactgagggtacacagagagcaaaaacagctctagctgctgagtgtcctgcttatactctcacatttgcccatctactaatctctattactgttttatcttatttttacagatcctacatatctaggaggttccttttaaaatgcaaataaaatatctaaatgggagtgtcactgacttcattatcattcatcaacaccataacagggattattttatcacattagtttgcttcagagagttgagctgcaagaaaatgggactgaattcacttatgttttgaaaatgaaagtgctggataacaaggtagcagttttcaacaaatttaaatataaaaacctttattaatataataaaatgtctaatgtctattaaattatatagtggcaaaagtcttagagaattcagggacatgttaatattatcaattataaattgtactagagaaagctactccaaatgggtggaaatcaaagaagctgatcattttccaaggaatgaccttgcatgcttttacctaaaggaactgtttaaatttttagatcagaaaaataagtgaaaaaaaacagaagaatggtctaaaatatatatacttatttaatgttactgtcagaaaatataggcttgtaagagagcttggatttcaattttagaaagaaacttcggtttctttggagacaatgtttatattaattcaatagtgtttctgtacatatatatctgatattgactgccattgtctcttctataactttctttgagtcctaggtttatatttaatcttatgatatcttcatgtatatctcctataaatatttcaaacttaaatttttaaaagcataagacatcatttcccctctccagttgcaaaactcttccttctttgtaaatgaatgaataatacagcaaccactagaggatgcaggctagaatcttggaagtcttactttatttcttctcttatctcattatgtccttactttcatgtttacttttgaaactatccagttctctctttttctgtaaaaaatccagagtctcctatcatccagtcaaaatttctgctgtagttgtgtaaccagtctctttaatccaaggtatattttcagtgctatattagcagtcatactgaaaaaataaactaaccattgttatttgggataatttattatgcagtaataaataactaatacgctaaattgagaactcctggaaagagagaaaaacatataaaagattctttttttttacactaaatccctaggctccatctcactttgatggtattagacacaatagaagctccatttttttctgatgtatgtagaattaaaataaataaaagcaaaacatcaataattaaaacaactataaaaatgtgtagctcaaactagagggaagctggaatggcttgaggaaggaaaatgataaatgaaatcaaagaattgattcatgtgaaataaaagaaaaatgctttttgcaaacaatactgctgactaaagggtatacatcttatgaaatgaaataatttatttttttgctcactgaacactatgatggagttatagatgcagaagtaattttgtagttgactttgaaaattgttttgaaaagtagaagaaacgagttagatgtttattgaggcaattggaggaaaaattgtgctgaagttaaggaggatagggaggaggagacaggaagagaaagaaaatatcccagagaagtgtaatggtggtggcattggatggcttgttggtgtcacttttttcatattttgaaattttttaatgtatgttcaaatcacagaaaggactgattccacttctgtgtagttagtgtaaatatagagagcacctactcagtgaaaagaaaattaataagcttgaataatttagaagaagatggaactcttagctagaggtcactaaaaaaagagaacatcaggaatgtaaagacatactagggagaatattgaactttcccctaaaatacagtaaaattttgagctgatattgtctagatctttaaggcaggaagggtgcagatgaaatatcagttatctaatatcaacatgagcttagtttaatgaatcatgagattgtacttatgttaaataactacattttgaatcagtgataactatccaggatataagaaatcatttattttccataacaggactgtaatgcagaggtttggctacacagatgatggagaagccaaatatctcccagtaggaagtcactaccaatactaattaggagggataaacgaagaggaggttcaacctaagccagaagatagtgttaacaggcagaagctacaatcatgtggacatgtcctgaaaaagtgggagccacaaaggatacacagattctggatactacctaattcagagagaaagggcgagggagagagaaataccctgtgttttctatttcttcacttaatttttatctgtgcctacctttgtccaaaaccacccagaagcagatgacagggttgcccagaaaatacaagattatcagtcctgttacacagagcacagcaagaaaagaacaaatcattggtcaaacacacccaggatgggcatagtttatatgtaagggggaccaaattatcaaataacttgataaaaagagtgaatctagagatataaagtaacaatgaagataaaattgccaccaaacaagtttgcctagcacaagctttgatatacactgatttcagagccccattaggatactggtgccactgagacaattaaatttcagaacccatttaattttatacaggaacccacttcagctcagatatcatatcattgccgtattcacaacatttaaattgatttgcgggcaatccaacttttaattctgactcatgtaagtcttctagatttacagcaacaccatgttgaactgcactggtttgtcatctctcccattccaggatctgtttatattcagcactgtatctcaaggacaggcaaatagagtcagatttttgacatagccgaagagtggtgactttagagaaccctatttcctcttataagagctttttaggaaataaccagttactagcaggtttaatgcattggcaaagtccaagtgtcctctacatctcacatcctttgtgtcatctataaggacataggaaggcaacttccagaagcaaaaatatgtctgtatcttctgccctcactttttaggtcaacacagccaccacaacccgagctgccattttcatttcctgccatggatatctgacagtccttcatactgaagaaaagtaagtttcattgatataaaaagttataggattattagaagtatttatacttatttttgtttttagcatgcccactaaatacttcagagttagtcataaattgacaagacaacccctcggctttactcatttcattatttattagttctcaaaacaattttctcaaagtgtgaaagtttcttttaaaaaaggtagcatgaaactatttcagccagaaatagcctatgaattcatagtatatgtgtcactttcctttgcctttctgtaatagttactcacagacctgagcttctgtaattggcttattttattacttggaataaataagattgtatacaagaaatcctgtaggagaggaaaacacaactcttgggcgtggatattattctttgacaacccaaagatttttccaaatggttaataaatggaccattatcttatttactcttgaggaaacttcttttccagcatctgaggtaatgacttcccagtttttgacctgccactgtaaggtttaaatttggttttcctcaaaactgatagatatcagaaattacatctaaagtgttaaagattctgagctacatagtactgggtgtcaaaaggttacagagacatccctataccagctgagagtccattaaaaaggtcactcacttctgttctcacaagtattgttcactgaattgagtcaagaaacgctcaataaaagggaaaaagaactaaaattgttcctgagaattacctgacaaaagtgagatcaccgaaagaaatgatttaggaccataccacggagagacacaaagtggtaccagagaccagctcattaagtttaccatatacaactatggtaatttgtttttaaaagatattctaaaacaggtaagtcaaagtttcacatatggaaatatgtccaaattaaaatgtgcttgtcttcctgaagagtctgggtcattcattaaaaaaaaaaaaaaaaaaaaaaatgtttgtccaagattttagagcaggaataaaatatcttcatgagaattacttttctattcataacaggaatttgtagtaactcaatgcatttttataattaaaatgtattattaattttgtgtaatacaaatgaaattggatttagagataagtttctggatgacattgaaaactcagtattagaaaaattccaaataatttatagagaattctcaataatttatttaaatactctgccatcaagtagatacagcataactgctcaccacttaagtgtgagatgcatatagtgacttccttctaaagaatatagtatgaaaatgaggggaaaaataacatctgtacaatcaagatacctggaaaatactgctttagtgagttaatcaaggttaacatcattaataagttgttgtttatagtatatatagtatatataccaattataaatatatgttgatagtgtatccccttgaaatggtacaatgaaaatggcactttacctctttattttccttgaaatagataaaccatatctagccatgagaaaaacccagacttaaggatttttcataaaatatctcatcatgttcctcaacacttttaaaataggcctactttgttttattgtgctttgctgatgctgtgtgtttttttatttgtttgtttgttttttaacaaattgaagggttgtgttaactgtgtccagcaagatgtgactgaattgctgcaatcttatgatcaaatttggagagatgagagttgctttttatggatgagcaaataacatggtttcttgagatgtaatctattcctggcgaagatgctgtgaacaatgttgaaataacagggatttagcatattacataaagttagttgagaaagcagtggcagggtttgagaggattgactctaattttgaaagaagtacattggtgtcatttttccaacaccatgtgctcacttcgtgtctctgcgtcacattttcgtaattctcaccatatttcagacgttttcattattatatctgttaaggtgattagtgacctttggtgttaccattgtaattgttttggggcaccacaaaccatgcccatataagatcacaaacctaatcaacaaatgtatgtattctgactgctccacccactggcgattccctctttcctccccgtctcctcagtctctctattctttgagaaacaacaatattgaaattatgccaattagaaactctacaatagcctttaaatcttcaagtgaaaggaagagtagcacatctctcatttaaaatcaaaagctagaaatgattatgcttagtgaggaaggcaggctgaaagctgagataggttgaaagccaggcctcttgcaccaaacagttaaccaagttatgaatgcaaagcggaagttcgtgagggaaagtgctatttcagtgaacgtatgaatgataaaaacaggcttatggctgtgtgatctggataaaagataaaaccagctaaaacatttgcccaagccaaagtttaatctgtagcaaggttctaactctcttcaattacgtgaagacagagagatgaggaagttacagaagaaaagtttgaaagtaactgggaagtcattacctcagatgctggaaaagaagtttgaaactagcagatgtttgttcatgaggtttacagaaaggagtcattcctataatataaaactgcaaagtagagcagcaagtgctaatgtagaagctgcagcaagttattcagaagatctagctaagataattgatgaagatgattaagatgaacaatggattttcaatggaaacaaaacagtttaatatgagaagaatatccaaataggaatttcatagctagagaacagaagtcaatgcctggtttcacagcttcaaaggacaggctgactttcttgttagaggctaatgtagctggtgattttaaagttgaaactgaatctcatttactattttgaacattttaggccccttaagaattatgttcaatctactctgcctgtcctctagaaatggaggaacaaagcctcaatgatagcacatctgtttacagcatgatttactgactatgttaagcccactcttgagacatactgctcaggaaaagatttgtttcaaaatattactatttatagataatgcacctggtcactcaagggttctaacagaggtatacaatggagaagcatgttgctttcatgcctgctaacaaaatatccttctgtagcccatggattgaggagtgatttttactttcaaattttattgtttaagaaataaatttcataaggctacagatgccgtagatcgtgatttctctgagggatcttccggaaaagattcaccattctaaattccattaagaacattagtgtttcatggtaggaagtcaacatatcaacaatactagaagtttggaaaaagttgattccaaatctcatagatgacattgaggacccaagatttgaatggagggagtaactgcagatgtggtagaaatagcaagagaactagaagtgggagaggagctgaaagatgtgactgaattgctgtaatctcatgatcaaacttgaagagatgagaattgctttttatggatgagcaaataacgtggtttcttgagatgtaatctattcctggtgaagatgctgtgaacagcgttgaaataacagggatttagcatattacataaagttagttgagaaagcagtggcagggtttgagaggattgactctaattttgaaagaagttctactgtgggtaaaatgttatcaaatagcattgcgtgctacagaaaaatctttcatgaaaggaagttaattgatgtatcaaactttattgttgtcttattttaagaaattgtcaaagatatcccaaccttccttcatcagtcagcaaaagccaatattgaggcaagatcctccaccagcacaaacatcataacttgctggagagtcagatgatcactggaattttttagcaagaaagtatttttaatttaagatatgcacattgttttttaggcataatgttattgcacacttaatagattacagtatagtgtaagcataagctttatatgtgctggtaaccaaatagcttgtgggatttactttattgaggttgcctggaactgaactcacaatatctatgaggtatgcctgtattatcaaaagcaaggaaagtctgagaaactgtcacagtctatatgagctcaaggagataagaccaccaaatgtaaaataatgtcctatataggaccctataacagaaaaatgaaatgacataaaaactataaaaatctgaaaactgtatggacttttgttaatcataatgtatcaatatcagttcattagttgcaacagatgtatcatggggaaactaggtgtgaaatttaagagaagactaatattcctgcaactcttccataaacttaaaactattataaaatgaaaagtttatttctttaaaaacttagattagtaaaatatagttaaaatattaataaactccctgaaaactatgaataatgataactatgactaacatgattgtattttgagtgatcaatctactcagatattcagtatatttcaaatttaatgtttgcttaatggaaacatacttaaaagtaaaacattgcccagaagtaaatgaggaaagttaaattttaaattatgatacacatgtaacatatatggaattgaactgcagcctttcctaactttatatggagcatctccacctccctacttgccaattccaacactaacccaactctaagcacactggcaaatcatattgtgtttacagatattgtcttgggatggggataaaggaaagaatacattgtatctcatatagcaagcattataaaaatgatctttaaaccttttttttcttttttttaatgaaaggtctagaaggtttgtttagctttattctcacactctccagaatctttttctttttctctttttgaagaccacatgggtgcagctttattccactcttagtttatctagatcctattgtttttgtagttaatttaaatctctcttgatttatttaatttatagccttacatatcaatatcctggaagaacttgaaaatgttcctttagatttttatttttaagaaggaaagataaaagtattgcagataacttttttaacttcctttattatttgctctgccacaaacaacctatataatattcagtatttttttccaggattaacaaaaggaaactttgttttcaacaatttttatggtgcaggagtactatctggcaatacaagtttatttgaaacagaactgcatgacactcacatattaagcactttatgaaggaaaaccgtaagaaaatatcctagaaagtaaaatgttggaatataaaataaggaatcctatgctaaatctctgcctttggtgatttcaatgattgagaccaaactcagatttccatcaagattcgtaaaacttatcctgccattgttgaattcactactggagtatatatactgttcctggtcaatttttagaaacacctgagctgataaaagttaaaagaatcacgaggagaactggaaatactgacttataggagataataaatatccttagattcatatactatgaaaaaatgttttgctgtcttcttagctgctatgctttctatttcttttttttgacacacaaacattagaattttcaaacaaatttactaattttatgaacttactattttatttatttattattctatgtacagtattccattactatacaatgaagagtatattttctttcatttttaggtggttaataaaataattcacacaaggttatggctaatcaaattattgtagtcaagaagtcagaattgcagataacagctcttggaagtccacccctaagtatggagggtgttcatgagtttaagagaaattttcgtgaactgactagtcacataaactggtttctactatagttggggacaggactggctgtataaatgacagggtatagtgcaaaatgaagataaggggctgcttattaaaaatttattcagaattttaaaatggtgtcaaaagatcatgaaaccaacagcaagaaccttttgagcattgagtcctgtgcaaatgtaaaaaatcatgaagctggtcctgcataggggtagtgagaattagggaataaatactattttccttttggtaacttagtgatcccctgttttaagtatgaatccataatcttaaactattttctcttctttggtataccattgcatgtactatctctccttttaagcttttctgcttttctcttgtatttatttaatttataaaccttcaaataaatgaaatatgatgaggggacagttcctcatgtagcacttagtcataggtaaggagtggaaaagcgcttcatggcactttattttaatgtttaatttatataactatacgcctttttgaaacctgtaaggacaaacaattgaacatctaaagacagatatccatatgtactgtaatttcctgaattctacatttttgggaaaaaagatgttcttctatggtaagggaaatatatgtatactcacacaaacacactcacacgcaattatatatttttagtaccctattacgtttgaatataacatgaaataacagacatatgcaatgcttacggaaaattgatatattaactttctgatactgtgatcaccttaatttcttgataattcattttatttgcatgtgaagctttgtaaacttatattttgaaattgaaagagtcaattagaaagcacctcaggactcatagtgtccttcttttattgctttgtaacacactgcttttatgtaattgctttaatactctactatgtagcactagtgtgacaatgattattatgataatgatgataataaaagcgatatttaataatataaattgtaccttgaaataagctgtaagtacagtctacagagcttaaatgctaaattctcaaaataactcggtctataagtggtagtcttttatttgtttttctgcagctcctaaacactttccaaaatgtattcagaaagtgattataatggaaagatggtcttccttaccaaaggaatgtttagatcctttctgagacctagggactatatctcacctccagagaaccataggtttatataaccaccatatatgagacggtaaaatattaattacaacaataagcatcttttgagaactttttccaggctatatcagaagcaaaaaaggttttgtttggtgtttgttcttgctttgttctatgccccttccatgtagtgaccattattatacatatcttgagggaactgaggcttaaaaagattatataaatttaaacagagtaaatttgcacaaggctatgctacaatgttaaaatactttcacagaactttataacttacaaagtattttcctatttagctcaataataaacacataaggtcacttaggctccaataataatacaattttgaatgaatgagatattcttgccttatacttccatggaagagaaaggaattgcattatacactatttccatgatttagttacagacatattgctatgtgaacagaaaggaggataaggcaaattctacctggaactttcggatgatttcatgagtggtcatttgtaccacttctcccaagcagttttagaattatatgagcaaatgtatgaagatggtaaaaatctgtgcctgcacaaggaacaatacacagtctggtttggttagagaatagaatacaaaatggcagctattcttggaaaatgcatattaggctgatctataaaactttgaattcctacttatatgtacaggatctttctgtgtcagttttgaatggaggcataatgaaaggatggagaggcaagaaggaggttacttaaaaggctacagctaaggcaaagttaataatcaccagagattagacagtagggaagaaactggatgcaaattcaccacactcattttactttttttctggtcacaccatatttctagacttcctttaagtaaaggttaaggataaattaaggttaaggataaaaaaaaaggcaaaagtaaataaattatttgcaacctatcatacatatctaacaacagaataaaaagataaaaggtactgattctgaacattcccaaaatttaccacttaatttctggaagaggtttatcttctactcaaatttagtgaagagagaaggtcactgtggcttaatgaaatggctcatctccaagctaatgtccaatctcatatcagccaaagtatgatcaccaggttacattaaggatgagcttgatatatattttttcactcaaacacccatcagctttgcaatgcaatattctctctcaaaggcaagggagacatcgatgttaaataaaaaacaaaagaatttagaacaatctattttgcattgttacatacttatacaattgcaattaatatttgctttattttaatctaccataaaattgtctgtaaatggaatttctcctcaataaatgagtgctccacatcttttgccccatctttcagctcaataatccatgctcagggtggatgtggaaaccccgtattgaagaaggcagcatgtcaagaaccacagtgttgaaatgactacatgctctgttataaacactaaaattttaaggtttatctttaatatctgctagcattatctggaatgctaaacagtactatagagaaaaaataaaagggaaggtggaagaaaaataacaagttagtcaaggttgttataaaatgtgacgatttagataaacttaacaaaattttacctctggtaaactaggatgttggcactataatacccaaaatgggatacataagaaaaaatgaatctactctgaaatgtaatgatgatcaggctaagcgtatgttagggtttagagggagcgcccctaaaatataagaaaaatatttgaaaataatactttgaaactatttttgacagctcaaagaagcagcagcttctttcttgaagcagcaaagtaatcatacgggggtaatcacaatgtttcttatgctcttatatgcactctacagtttggcattgtttatcaatttcattctttccagcgattagagcctctaaaaattcatgctagtttagaagtatgtctgtgtttaggtatctagagaacaggaagagagttcgatatgttgctcagcagagaaaccaattctaagagtatatggcacaggagtcaaacccttagaaagattgttagagccatgaattggtataggaccacaggagacaccatagaaaaataagagtagagtgtcatcaggctatagtcccatttacaaaaaggaaggctaattagcaaaactaaatatagtcaagagataggagaagaaacttaaagaaaggaattatcactagcaaatataatgagaatataccaacttggacttatccttactggaggcatcagggaaaccaaatgggttcattggccaaagtgggcagaaagatagctttgaaatgcatctgtcatggtttggatcatggtacaaaagcaagttaaacttatgtagatacatcattagtagataaaatctttatttatttatttatttattttttgagacggagtctcgctctcttgcccaggctggagtgcagtggcacgatctcagctcactgcaagctccgcctcccgggttcaggccatttcctgcctcagcctccctagtagctgggactacgggcgcccgccaccacgcccagctaattttttgttttttcttttcttttttttttttttttttttttgagaccggagtcttgctctgtcatccaggctggagtgtagtggcgcaatctcggatcactgcaagctccgcctcacgggttcaggccattctcctgcctcagtccccagaatagctgggactacaggtgcggccaccacgcccggctaattttttgtatttttagtggagacggggtttcaccgtgttagccgtgatggtctccatctcctgacctcgtgatccgcctgcctcggcctcccaaagtgccgggattacaggcatgagccaccgcgcccggcccataaatttttatatatttcaaccaaaattagaaaaacagaataataatagtgaaagaaccagaaagtgacaatcttcaccaaacgttcagtctcaaatggtatgggcaaaagcacaccatgcacacagaagaaagggcagactgagatgaatgtgggtcattagggttcaagaagtgttatggaaatgaagggagtaaagaaaagaagaacatcaatccaggatacaaaacccatggataacttcagacaatgcatttttacagctgtgaatattttaatatgatagctaagtaaagcaaacatattaaagaaagttgaagagaggagttacaaaagaagtattgtctagaggagtcagagggaaatataatttgatagagaaaagaagacaatggcattaataagcacttagtatatatgagaaagttgctagagaggatggtgggcagaggagaaggattctctgggttcaatatgaaatttctccacttataaattatttcaccttagggaagttattcatttttaatatgctcacaaataaacaggataataatttgttttcatattatttctttcagagggagtaaacagagatccttttaataattatgatgtgacaacaggtgcaaaacttagacaaactaaggtatctgatcaccatatttactaggcaaaatattgaggttaaaagaatttgtgctttgttttttcttttcagttttcaacgttctcatcccagtagataacaaaaggtctgtgacaagatgggacatagcaattctgtctctgtgatctgcccatcaggaaaagagctcttaataatccaggctaaccttttctgcagttaaatgtacccagtttcctccttcagtggtatgatcttagacatcagctttctttgagggaaatcttcatagagacattgagagaaatctttacaatctaaaattacataatggaataggtctgtggttatagttcagttttaactagggacatacaagtcataatgtcttaacttcaaatatcgaaaatccataagaatttaaggtatgagaactgaaggacagaaaaggcagtcttatttgtgctatgagatgttcttaaatccctcacataattgcaccaggaagtatactttctttcttcatttatctcttaaagctcggtcttaagacgaaggggctaaaggcctgagtttcaatttatatttgtttcataatagcagtgacccctcaagaaatggccactaaactgtgggaaacgatgaattcctacacagtaaaatagattattttcttaaaaatggcacaaggttttatgagaattacagcagaaacattgcttagcatcatgcatggcatgtactaaatattcagtctatgctacttaggtatccttgatgttataatatgaaattgtggatatttgtaaatatgcagtctcctaatacatagttgtaaaaatgtgtgaaggtgtccagtgagcaattaatagattcttaaataatattccattcttacccttcatgatttgtatggaagatttagagaatgaaacaaaactctgggatctgtaccttttaactgaaacaaccaccagaactaaatttacataaccatgataaataaatctctaaataagataagtatggataaactttgtaaactttctctttttaagatacaaacaacaataatagtgtgggttatttcttcataaatcatatacactcccagttatttgtgtcaaacttctctcttgtgcctgatggtttccaattcaaaacatggtaatatttttccagtattcaaaggaagttctgatttgtcagtacatagaacttaccatctccaggcatacgtattgatggaatgtaagttaacaattcaaatctttttttttttttacattgggtggtaatttggatttatgtttctttaaaactaagtcattggtgtcatgttcatttccctatagctaagattccatcatactgaaccagaaagaaatagtatgtgtgtacaaaaatgtaagaaatcagtactccaagctatataataggttgtcaaacattattctcataaaatatctatagacacattggccaatatttacttattttttatagtaatgtagaagcaatagtagttaaaaacagggactttggagccagaataatctgtattggctcccatctccatttcttatttgctttgttctctaacaagtctcaaaatttcttgtctcagttttctcagttttaaaatggggataattatacatatgctttacatagcatatttaaattactaattactgtagtaattaaatgttagcataactaaagtttatacctgtcgggtagtaaatattatgtggttgtactaaatagtaagctgtggttgtcaattctaatattcttaatagtacacacttcattgtgttctacagatattgattaaatataatttttgagaaatttaaattttgacttttctctaacatattaaaatattctaaaatatagaattgctgggttcatgagactatagaaaccatatgtgaaaataaagtaatatcagcatcctatagacatcttctagaatcatagaataaaaaaggttctttatctgttatttgtatttcattttattaagctaagaaagattaaggataaatactcttgaaaaatacataaaaataataaaaattaaaaataaataaaaaatacataaaaaatataaaaaatagaaacgtaaatctacattgccacccaatgtaaaaaaaaaaaagatttgaattgttaacttaaattccatcaatacatatgcctggagatggtaagttctaggtactaacaaatcagaacttcctttgaagagatttattaagagatttgatgaaagtgattttaaaaatgcaaacacagaattaatctcttgctctgactactgccctatctcctaatttgttgttctacttctgttcttgctcttacttattctatttttcccacagtagccagagcaatttttgtaaaacatgaaactgattatgtgactgttctgctaaaactcttcaaattcttccactgtgcttaaaatacaactaaattcctcacctttgtttacaaaactcatgtaatctgttccttgcctaatgctctcacttaaattcataccattctctttctcacttatttggcttcacccataactttctatttctggaacacatttatgttcatttccagcaaagacactttgtaattgccatttcctctgactggtaagcattggatctagattttagcaccattaccatattcttatgattcagatcttaactcagtgacgcctcttttcagaggactttcccaactaccaaatcaattgttgtttaaattccattcttatcacgaatacccttattaattgtcagtcacattactcttgtagcatattaacatgattgttctcagaaattatctgttcattcatctacctcttgattgcaagattgcaagctccttgagaccaaagattttgctggcattttccactggtacatttttcccacccagaacaatatttcctaaattacagtatcacaatacatatttgtgtaagcaatgaataaaaggacataaatcaaaagagaagcttgttgatatgctaatatgaagatgctgatgttcaaacagaattttatcagtaaatttggaataaaaagtgttggaaaagatattcaatggtaatggggtgagtggttgatatgtattgtacaacagcaactgagaaacattaagtgtgaatagaaatatcagcaaatgcaccattgaagtagtatcagtagtacacaaagccaattcatcatgaaatagtttacactctaactcttccataagtttcatatttggctctttctttagatcccctttgcccactttattttgggctatcatatttcttcctgttttctaattaggtgttgtctttatactgtgaatcttagtcttacttgaatcaatgattagtagaaatcactgttgtgactaacatgcttcttcacatatgtgtttaaaagtaccctaaaatcaattcatttaaagtgaaagcctgactgttttttaaaatatctttcaatactacttcattatcacattaaataggcaataaccttgcacctcattattttatattgggtcttggctaactgtggctcttggactaaatccagctggccagctgtttttgtaaacatgattttattgaatcacagccacacctatttatttattgtctatgactgctttcactctacaatgacaggatcattgcaacagagactgtacagccaacaaaacaaaaaaatatgtattatctgccctttatcagaaagcttccttgtccctactttaaaccactgttttacagagattaaaaactatataaaattcaaatcattttcttccatcagctttactgagtcatatctgtctctctccctttccatacaatataaagattacctttcaagatctcttattagcctttaaacattgaagacattggcaaacagacactactttgttttcactagtttcttaataaaactgttaattgacaagttaccttatttagcaggaagccaataaaccacagtgtaaatcagtagattacgctgctttaagcttttgaaaaaatgattagtctcactaaagggttgggcaattactgccactgctaactaattttgtacctggaaataaagatctgcaatttgttgcccatagctatagcacacagcctgttgacttagtacctatacagttataaactatggattctaagaaaatttaaatgtatgatgtttatttaagtatatatggttatgatgttatctaaagtacatttattatgaatttcttggtatataatcattcatgcagataggaggatctctcattttgcaataaaacttttaattttgacccacacaaggtaaagagatgctcttgaggtacctgcttctaaactacaggcgatgaatgtgtgtgtggactcattggtgaatcctcatatataaacaaagtagatgatatattcatgctaaaaggaatctgacttggagcgaaggcccttttctagaggcataagatttagtcatacaaaaacacttaaataattttaaaggcatcagactctctgtacagtagggattataaaagactgaaatttcccttttgtaatagggtttctggcctctctggccctccagaaatattaggtatagcttaaaatcagagaaaaataataccaattgccagagaatgctttgtccttcatgatgtcaatagctgtccctcactggttgctctgatctcttctttctgtcagcttctcttcacctatacacagacaactatgatttgcaggccagaaatgtaagagctatgcatattggtgccacattaaatccatggtcatcaccattaaatgagtccttaatatagcaagaccaccttgtttcattttttctgtaaactcctgtttccctcattactatcattgtgtaaaaactgtgtgtcaaatagagttattaacacccgcacagttggacatatgcgagttaactatggctttgtcacacaggaatggcatgatctggaaaaaatgggttaaactctccatctcttagttttttctcctgtaaaatgatgacaataatgtttataacatatacttgtgatagcattaatggtacatagcatatagttagtcctaataaaaatgatttattgtctccatcatgcctctctgactcctcctcctcctcattgtttttgaacatgtaacccatatgctactctttcacctgagaaattagaacaaatacaacaagattaaccctgcacctttctgtttctccttttatcatctttcaatggaggacttggcttctttctaagggccatttctctctgtcctctagtttagatgccttctaattgaatgctatttactgttcaactacttgttattttcttaacatttccttgtaatataaacactctctcattaaaagtcaattatggaaccaaagaacttctgttgcatatctccttttgcatggatggaccttttggtttcccttatctctttgggtttaggggtggtaagggattcccattgttgctaggcatgaggtatttcaacattctgttaaggtttcctcactctgttcacacttctgtaaatagttatttcattgaaatatcatattaaactctgtgtgtgctactgttctgtgccaggaccatgactgatacagatgcctatgatctttatggagtcagtagaagtgttagtctaagtttctgggttaatcatccaaactctattaatagcttattacatgccagatactgagaaatttgaacaattgataatgaatgctaacttaagactaataagatcaaacaatcagaccttatttcaagaaaaaagccctgctacttaccttaggaactaatttctcttcttttccaaaatatatgccatttcaaatgatcagtttaccctcgacactagaatattttctcttcatcattccatatttaaaaacatttatttaacataaaaagagcaagttaattacaatccttgtttccttggccacagttatagctatctcacagaggagaaaacacattttatatgaatggcacctatatttcttttcaccgagacacatttaacaacccatcttttaaagcacaaagaaaggagaaaaccttcagaaatatgtcttttcaaatgttgttaaacattgatttgtctgattattataacttgagatagtccttattgtagtaattgaatacttaaaatttaagaatttatgccatgttatatgttaattttatgcatccactttctatttctcctgttccagcctcccacatcctaggacatctgtgaagataacaaaattgcaaatgccagatggtagtatgatcattaaattaaaatcagttccactcttgtttcaatcatgaaacagaacgatcaaatttgtaaatgtttctattttggatattattttattttacatgaaaacaaagagatgtactttaaaaacattacattggtaaattacagtatttttttctctactaatcttattttgtaaggttctaaaatttggttgactaacacttgtgttctgcaaattagtttacctaaaaagaggaataaataataataaactttgaacaaaaaaaactaatataaaatactgttatatttcacataactaatggaaaaaaaattctgacaggctttcttgacacaaaaatattaggaataaattttgttccttgttgcagggtgaagtaaggaagatggttgaataagtaccaaaccctcctctgaaagggacaccaactcaacaatatgcaaaacattctcctttgtgagaaacccagagaccagccaagagactcctatagcccaagtgagtatcatgccagccacactgaagttgatgggaaaatttgtggcacccacttgccaaagccctgcccttagctcagaaatgtgcaatcagaaggaagatcctaactcctcacttctccctggggaggaaatagaagactggaacatatgtctaatgttcagatttggagggaactagctaagagactgatttcttccctatttgaatctaagtgctgacaggaaagggtgtcagataagaaaccagtggaaacagaggcagccctttgaactagcacacactcagttaccatcatctttctccccagctcagcataacagtttcacctgacttggcatactgacaggaatttgaatgctctagatgcttgaggatactgaaaacaaacataagagctccagaggacctacagtatagcagacagaagctgattcaacttgacagtttgtccctcagggggaaaagagaagaataaaaggtgtgtcaaatattctgactttcgggaggagctgcctgaaaaactggttgtttacttgctagtctcagagcactaaagggagctggcatactctaaatgcctgaggccaatgaggagaaaaagaaatgagtgacttacagtaacatcaaaggatcttcattagtggagacagacaccataagaaggaggaaatttcagcttctaaaaaaggaaaccagtaaaatctccctaattaggaatttacaaattcacagaaaacatttgagagacccgcaaaatatgtagctgggtcatttcaagaaaaactttccctgtttggagctggtccacaaatactgggagagggggctacttttcaaatgcatagatcccaacaaaaagtaacaaggcacatgaagaaactgttgtaaccaacagttgggcacatgagccaagcaaagtatcaaaaaactatctccagaaataagtcctaaagaaatggagatatatgaattactcaacaaaaaattcaaaattaaccattgtaaagatgctcaatgaatacagaaaataaatacataaaatgacaacatcaacaaagacagaaaattttcatgcgagtccatgtgaagagaccaccaaacaggctttgtgtggcaataaagctttttaatcacctgggtgcaggcgggctgagtccaaaaagagagtcagtgaagggagatggggtgtggccattttataggatttgggtgggtagtggaaaattacagtcaaagggggttgctctctggcagcaggggcaggggtcacaaggtgctcagtggggagcttctgagccaggagaaggaatttcacaaggtaatgtcatcagttaaggcaggaaccagccactttcacttcttttgtgattcttcagttgcttcaggctgtctggatgtatacgtgcaggtcacaggggatatgatggcttagctcggatcagaggcctgacattcctgtcttttatattaataagaaaaataaaacaaaatagtgttgaagtgttggagtggcgaaaattttgggaggtggtatggagagataatgggcgatgtttctcagggctgctgtcagtgggattggggcagcgtgggaacgtagagtgggagagattaagccgaaggaagattttgtggtaagaggcaatattgtggggttgttaaaagaagcatttgtcatatacaatgattggtgatggcctagatgtggttttgtatgaactgagaaactaaacagaagatacaagatctgaataagagaaagagaaaaacaggtatttaaggactaagaattgggaggacccaggacatacacttagagagtggccaagggggttcagcgtaagtttttgggctctatccttgtcagagttctcctttttaagttggaggctgagcttgatgaggcgtgtttttaaaagaccattagtccattctacgtttcctgaagattgaggacagtaaggtgcatgaaagttccactgaataccaagagcctgagaaactgcttgggtgatttgattaataaaggccggtctgttactggactgtatagaggtgggaagaccaaactgaggtattatgtcttacagaagggaagatataaccgcggtggccttttcagaccctgtgggaaaggcctctacccatacagtgaaagtgtctaactagaccaagaggcattttagtttcctgatatgagtaaagtcaatttgccagtcctgggcaggggcaaatccccaagcttgatgtgtagggaagggagggggtgcaaaactaataaaaataaacacacagaaattttgaaactaaagaataaaattatataattaaataattctctagaagaactcaaaagcaggcttaattgtgcagaagaaaaacagtgaacttttgaaatgacaagcaaaaagaaaaagaatgaagagtgaagaaagcctaaaagactgatgtgactccatcaagggaacaaatacacattatgagagttttagaaggggaagagttaaagaggtaaaactcttgttggaagaaataatggcagaaaacttcccaaattggggcaaggaaatgaacaaccacgttgaagaagtccagtggcataaactcaaagaagacaacaataagacacaatgtaatcacattgtcagaaataaaagacaaagagaggattttaaaagccagcacaatattgcagtgaggcgagatcacaccactgtattccagcctgagtgacagagcaagactccgtctcaaaaaaaaaaaaaaaaaaaaaaaaaaagcagcacaataaaagtgattcattatatacaagaaatcctccataaaactaacacaggattcctcagcagaaatattgaaggccagaaggactagaatgacatattcaaagtgctgaaataaataaaattgccaaccaagattactatatggaacaaatctgtccttcaaaaatgaaaaagaaataaagacatttccagattaacaaaagttgaggtagtttataattatacttgccttacaaaaaatactaaagggagtccttcaattgtaaacaaaagaatgctagatagcaacaaaaaaaacatattaaagtatacagcttggtagcaaaggtaaatatttaatgaatacagaatccttcaatactataatggtagcatatgaatcacttttagttctggtgtataatgaaagtattagtataaaaatacaactaaaataaatttatacacaatataagaaagtataattgtgacagtaacagaaagtgtatgtgtggaggaggaagtaaatatgtaaagttttttgtatgcaattgaaattatgtgttatcagcttaaaatagattgttataattataagacgttttatggaagccccatggtaactgcaaagaaaatatctataagagatatgcaaaagaaaataagaaagcaattaaacactgacagtataaaagtcaatgggaagaaaagactgcaagagaggaaaagaggaacaagaaaagctacaagatagacagaaaacaatgaataatatggcaataataagtctttatcaataaatattttaaatataaacaaattaaaatccccaataaaaagatacagagtagctaaacagattaagataaaaaccaaaaccatgatttaactataagcaccctacaagagactcactttagctttaaggatgcacataggttgaaaatgaaaggatgaaaaaaagatattatgtgtaagtggttagcaaaagaaggcagaggtagccatatttgtatcagacaaaatataatttaagtcaaaatctgtcataaaacaaaaataacatcttagaattataaaagggtgaagtcactaggaatgtataccaaatatatatgcacatagcacccaaatatgtaaagtaaaataggcagaactggagtgagatagagagtaacatgatgatagcaggaaatcccacactccccttttaattatggatagaaaaccagatagttgaccaataaggaataagagagcttgaacaacactatagtctgattgaacccaactgatacatagaatcagtctacacaaaaccagtagaataaacattcttctcaagtgtacatattcttctccaggtaagaatacattgtaggttgcaacacaatcttaagaaatttaaaacgattgaaatcacaccaagtatctttcttgcacacaactgaataaaaatagaaatcaatacaagaaggagaagtggaaaatttacaattatatgaaaactaacacactaccaatggatcaaagacaaaatcgagggaaattagaatatgtactgacacaaacaaaaatgaaaacctaacataccaaaatttatgagctgtagcaaaagcagcactaggaaagaacttcatcgtgataaacacctacattataaagaaaaggtatctcaaataaacaacctaactttataccataagaaactagaaaaagaagaacaaaataagcccaaagttagcagaaggaaggaattttaatgattagagcagaaacaaatagaaaatagaaaaacaattttaaaaatcaacaaaaataagaattggtttattgaaatatcaacaaaattgacaaaacctcagctagactaagacaaaaagagagagtattgaaataaaattataaattgagacattacaactgatgccacagaaattaagattataaaagagtattacaaaaattatacgtctacaaattgaataacgtcaaagaaatggatcaattcccagacacatacaacctactaagactaaatcatgaagaaatagaaagtgttaacaggcatatatctagtaagaaaattgaatcaataagcaaaaacctctcaacagaaataaagtctaggactagatggcttaactggtgaattctaccaaatatgtagagaggaattaatgtcaatctttttccacttgctaaaatattgaagaggagacaatacttccaacatcattttatgaggccagccttattctgagattaaagctagattaaaaacactagaaaaaaattgcataccaatattccagatgaatacagatgtaaaaatcctctgaaatttcctagcaaaccaaattcagtagtatcttaatagaatcatataccatgaccaagtgggatttctctcagggatgaagggactgttcaacataggaaaatctatccatatgatacaccacatttacagaattaagagtgaaaaccacctgatcaccttcatagatgtagaaaaaatttgacaaaactcagcactgattatgattaaaaaaattaaaaaaactagaaattgaaaaaaaaatctcaacacgatgaaggtaaaatatgtaaagcccatagctttatcacagtcattggtgaaaaaaaaaaaaaaaaaaaaaagaaagaaagcttttctggtaagatcagggataaggcaagaatgtgcactcttatcacttctattcaacatagtaccagaagtcctagctagagaaattaggcaagagaaagaaataaaaggcaaccaaatcagaaaggaagaaataaaatcaattatattcacataggatatgaccttacatgtagaaaacacaatagatctcatataaaaactgttagaactagtaaatgaattcggaaaatttccgggataaaaaatcaacatatagaatcagttgtgtttctacacgttaacaaagaacaattttgaaaaataagttaaaaacaataccatttacaatgacatcaaaaagaagaaaaaaatacttgggaattatcttaaccaagggaataaatgactataaaacattgatgaaagaaattaaaggagacacaaataaatggaaagatatcctgtataaatattggaagccttaatattattaaaatgtcattaccacccaaagtgatctatagggttgaggcaatcccatcaaaattccaatgccatttcatttttcagaaatagacaaaataatcctaaaattcataaagaaccacaaaggacccccaatagccagacagtctcatgcaataacaaagctagagggctaacttcaaaacatactacaaagctacagtaagcaaaataacatgatacaggcataaaggcagacatataaaccaatgaaacaagtttgagggtgcagaaataagcccatgcacatatagtcaactgatcttcaacaatacacaatgttgaaaggatagtatctgtgttagtccattgttgtgttgctgtaaaggaatagtggaggctgggtaatttataaagaaaagagttagttgccaaatggttctgcaggctgtacaagcatgtctccagcatttgcttctggtgagggattcaggaagcttataatcattgtgaagggaacgggagccagcatgtcacatgatgagagcgtgagcaaggggatgtggggtaccacgctcttttaaacaactagatctcgtgtgaactcagagtgagaactcactcattattgcaataatggccattaatgagggatctgcccccatgagccaaacattccccacgaagccctatctccaacactggggattacatttcaacatgagatctggaggggacaaacattaaaattatatcagtatcttcaataaaaggtgttgggaaaaattgaatttttttcacatgccaaagatattcagatgcaatagaataaaattgtattcttatctaacagcataaacataaattaactcaaaatagattaaagacttaactataagacatgaaactataaaattcccagaggaaaacatagtggaaagctttataatgttggtgcaggtcacgattttatgaatatgacacaaaaagcacaggaaacaaaagcaaaaacagacaagtgagactgtgtcaaactaaaatacttcaacacagcaaagtaaaaaatcaacagagtaaaaaggcaacctgtagaatagaaaacaatatttgcaaaccatatgtctaataaacaaacagcaatatccaaatatatgaggaacttgtaaaactcaatagaaaaaaagaaattatccaattataaatgggcaaaggacatgaaaatatacatctccaaaaaaaaaaaagacatacaaatgacccacatcttcatgaaaagatgctaaatctttttaaacaggaaaaaacagatcaaaaccacaatgaaatatcaagtcatccctcttatagatggccgacatcaaaacaaaacaaaacagaaaataatcagtaaggatgtgataataataatcctcagtaatcctcaataatcagagaggatgtgaatacattgaaacccatatcccctcttggtgttactgtaaaatcgtgctggggctataagaaatagtgtgaagatatctcaaaaattaaaaatagaactactatatgatctagaaattctactcctacatacttatctaaagtaactgaaagcaggatcttggagagatacttgcactttcatgctcactgcacctttattcacaaaaaccaagacatgaaaacataaatgtccactgacagatgaatgtttaaaaagttgcatatatgtgtatgtgtatgtgtgtgcatgtgtgtatgtaagtgtatgtataaaatagaatattattcagctttaaaaaagaaggaagtcctgtcatctgtaacaacataaatgacacttgaggacatcatgctaagtggaaaaagccaatcaccaggacagatactgcatgattccacttttatgagtcaccaaaaaatagtcaaactcatagaagcagaaagtagaatgttggttgccagagtccgaagaaatggggaaatgaggagttattgtctaataagtatagagtttcagtcatacaagatgaaaatgttttagaaaccttttctacaataaagtatatatagttaacaacactgtactgtataactaaaaaactgttaataagatatatttcatgttgtgtgagattttttcaccacaataaaaagtattccttgttatgacaaattaaaaacaagaaaatcactacagtatagtaaaggaaactgcatcctgaaatatttatgaattatttgagatcatgttgtaatctgttattaatctcaagtcgtacaatagcaatttgtttcttctaccaatttctcacaaagtgtggtctgcaatagccttcagtcagaataaaaactctggtatctaagaacatctccagacctactgaatcagaattatggtggatggtacacaggaatctgtattttaagtattctttccaggtgaaaattatgtacataaaacttgtgacgttgctttatatgaaagcttatattcatatatattatgcgctcctaaattttcacacacacacacacacacacacacacacaaagcaaatgttctcaatcaatataagttacattgaagttaaattcattgtttgactttgactctaagatgtgggtcacgtatcttcactaaactcttctaatcttactgatcacacttgataatccatactaatttcagatctagaaaattaagtaaaactattcaaagttccttaacaatatgaactagatttgaaagttccaaccactttcaacattacataagatcctgataatcatactatttgttttcaacctcagaaatagcaaaaaaatttaattttgaaaagcaaagaattgatggttttgaactttattaaaagcatcatcagcattttattcattctatagtaaagaaaataatataagaacttgaaagtctattaatgacagtaaagtaaactagtttattttgttttctaagattcaagaaaaatggatcacttctatggctaaactaatatcttgaaattcctttattatagacctaaaaatgtaaatatggtttaaagactgcaatttgtttaggttagccctgtgattgactctgatttatatgctgagttcaatttcagctttctattataaatgacctaataacaaatattctcacaattctcttccgacagaggagatgtggggattcctcaccatcagcaaagaagtgatcaattctgcagaaacaccagctgggctaactcaattcaattcaattcaattctcacactctacctcgatgtagcaactgagctacatctaactctattcaattctcacactctaccttgatgtagcaactgagccacaggttgaaggttcagtttcacgagattgcctcccactggccaccggtgatcattttaaccttcagccccaactcatccctagagccttggtctatctggcaaccaaatgtcatcatctatgggggccaacagctgtcagccaacttattagcatattagaagactttggagattctaaggattcaattcaattctctaactcaattcagttctcacactctacctcgtagcaaatgagccacaggttgaaggctcagtttcatgagattgcctcccattggccaccagtgatcattttaaccttcagccccaactcatccctagagccttggtctatctggcaaccaactgtcatcatctgtgggggctaacagctatcagccaactcattagcatatgaaaagactttggagattctaaggattttaggagttgtattccaggaaatggggtcaaagaccaaatgtatatttcataataccacactttgaagaaaaatttaagtgaaattaaatcaatatcaatatttcagtggaaagcttcagtgaggaagataatttaacaaaggaattaactttttgctttacgttaatgatcttcacgatatagcagagctgaattacaatggtaggctacaagcctttatttaaattttccccttagacatgaacaatgtgttttatgctagcagaagacatgagactcctgggccagagacaaaagaccttattacttatggcttaacaggcagcataaatatcattctcctgtcctctgaccaagacaattttaatgttcccctcagcttgagtaaatgctaaacagatttcttcttgattttaggcccctgacttccttcgccctttgagatgtaaagaatctttgagcctcttgctagttttatagctcacgtatatttgtcttaagaacttgagagccatccttctaaaaatctaatcattaagaaatatagtgcctctacctgtcaagctctgtgagagagtaggactctgactttggtaagtgccaatcagcaaacacagcctaatcacgttgacccctacctaacaaatagtcttcaatacttttccactaggctactccagcaattaaaaactctcctgccttttgtttcagtggtgttgagttcaatctctcccctactgcaatagtcttaaccacaattgcaatattgttgaataaagtttgcctccctgtttagctgtcaggtgcaatttttctttgaaattctgaagtctcttgggagcaatgaagagtggtccaggtagaagctgcagtaatagtttgtttatgtcactgctgagaaatacaagcataggaaactccagtttcatcagagggttgctagcaagtctgtccaatcttagctacggagtgggaagaaaacatggtatttattatcctgattaggagacaaatcttgtctctgacccaaaaggaaaccttatctgtatcttccaaggcttttagctatcctaacatatgtcataaataattttatatataagagttaatacttacataataaatgtttgttcatttggtatattataatttgaaaatattaaaatatagttatttcttgaaatacaaatatttttattattcaatcacatattagtttatttaatacagtgttcaacaaacatttttatagattgcctaatatatatcacatgctatgatcaagagctataagacacagtaaattcatgctctccgggagctccaatatagcagctaaataattttctagttgtgtaccacattcaaagaagtcagagccagagcacagagacaaatacagagtttcaagaggtgatgctaaatttatcagacaaggagaaggaaaggccatgtatatagtaaaaagaaagaaaagaaggtaaaatggctttaatatggagtatctgagggaacagtaaataccatatgagagtggctagaattacctggaaatataaacgcggtcatggcagaaaggaaagtttaggccactatcaataagttgggctttatttgtaaatgatgtggtgtcatttaagcattttatgcagaacagtactatgttcagatatggatcaaagagaggcaatgctctacactgagactgttattagaaactgtcatagtcttgaattaactacagggaatataaattcccaaaccttctttacccatggtgtattcatttcaaaaatatatttgatgtgtttttatcactcacgataaaaattgccaaattgtttctcaaaaatattttacagcagtattatatcttcattagaatttagttttaatgtcagcacatctgatgaaaaatagtctaaagtcaaaattatccttgtcagtttctgataaaggtgccattttgaagatccacaatctgtctttcaaagtactaggttactccagcaatgaaaaactatcctgccttttgtttcagtggtgttgagttcaatctttcccctattgcaatagtcttaactactattgcaataatgttgaatacagtttgcttgcctgtttaactgtcaggtgcaaattatccttgtcagtttctgataaaggtgccattttgaagatccacaatctgtctttcaaaataacaacactacttttttctccatggtaaaacagtttacaattcctccatggaaatatcagatgaagtagtggcttgtatttagggtccatgttttattaagataagtactctgtttttaaaaactagcagcacattcagtgcttactgaagctcacagtatcagggacatgagttggaactgacaaggattgagagagcagcagattcatattttcttccacaacccactgggtctaggacatatactcagcagaatggcaggcaacatttccaacagtatctgaatgtatccactccctctctcaaccatgtataattaaagccaagtaatttaaatagaaccagtgcaaatggactatactgtgtttttatttcattttctttgcaataatgctaattttggaccaaagttttaggcaaagggtatcatcactgttaaaaggggaaaaagctggttttccttttggtttctgtttattctttagtggattgtagattaatattcattgccttagaatttattaaagtcatgatacttgccaatcaatttttgtataagcaatttgtttggtggagatgtaacatgataacaataaggactgatttattgtcttcaaattctgataaaaccaggattgaaaacaataggagacaaacattctgctatgttacagaagggtgcgagacacagtcatgcaggatttagttaaaaatagcaaatcctcttatctccccaagctctacaagaaaataataacattttaatggattatttgaagggaattaataggctataaagaaagctgtggcacttcctctgtcagatggtgggagggggtccttttcctaaagccaaacgtgggagcacgttcaaaagaatgtagagaggacacccgccagcaccttctttctcaaacaatgtttgctgagctgcagaaatgtatagacgctatatggtacagaaatgaagtgttgtgtgagagtttttgatacacgtttgtgtgtgttctagagaatttggtaatatacatgaacctaggggctgttttccactggagaagtttaaaagcagcagcagtctgttttgagatacttcccatggtaaggtgaggagagaagggtcagcagttaaacatgtgtccttttttttccaccttttattttaggtttaaggggtacatggttaggtttattacatgggtacatcgtgtgtcacggggttttggtgttcagattatttcatcacccaagtaataagcatagatatgataagtagtttttcgttgttgttgttttctcttcttttgtttttcttttgtcttcaacctcctcccacctcccatcctccaccctcaagtgggccccggtgtctgttgttcccctctttgtgtccataggtactcaatgtttaactccaacttatgaatgaaaacaggcagcctaaagatgtatagggcttctatggcctgaggagatgatgcggataatgggctggctcctgttatttttatgtagtccaacctataatagggttagagtgagggtaataagatatggaaggaatgttttcacatgggtcactctataagggcatagcctatactagacaggtgagtagggacaaagtccctgtagcacttccaaaaaacagcaagcctgatatatgaagaagaacctcaatttgaatgatggacacatagagacgtcaatggccatatttcagcagcattttttctctaattcctttgctcacttcctctattgtttcttaaacctagaatcaagaatcaagtctgtgctgggaagaaagaagctacgactacgacatcaaattgaagttttgtttatataaactagacattttaatgtctgaatgtgtcagaattaccataataaaatttttcttttaattgaaattgattggaaagccaatagatagacttaaggttcagcaaaaagaatttactagagtataattgaaggcaaggtctggagaaaagtaaagtattttcctatttatatcacatagagttcaaccttcattccctgttcaatataccagctgcaagagtattaatcatttggcatatttgccttaatattctctttttgttgttttaacctctttttatttccattacagcgaaatgtgtgtttccatgcatatgtgagagaagacagttaatatgtccaaatttcatattttcctttgtaatctatatcttttatgtactgaatgagtcattcacattctagaaggtacaacaatgttgcaatatattctcattaaaattctaatgccttcaatcctcaaattaatattctaaacattaaattcatataaaatatatttgatcactgttctaaggtaagtacagaagaccatatggtgtgcttcccagatctccgttcaagactgaaaaacttattcccccatctactggaagtgcattgcgagattatttcgagctcttcctcaacttcaggaattgttctacctgaagaatgttgccttgattaagatcatgttcttcccagtgtcaccctacatctaatgatagccagatgcaggtataaaacaaacaaacagactgaaaacctaatcctttcttttctacttaagataacctgaagggacatctctagaggtctttatttagactgtatcagagcccattttctctggcgttcttcccggctcttccccagaagacaatgctaagagcccttaattgatactgatgtctacctctgcatcttgaaaaatctaatatgggacagaaaagactgaaatcagtcctcctccaaggtcagaagccatttattacaatgccattttttagtaattattattttctttctggtgctccaatggctccttgatcatacagtaaggaggcctatgtagtggagtcgacgcgattatgtggttatgcacgtgtatgcttctgtgcttgtgctagcacacacacaaacacatacgaatacataaacacacatatataacatatgctcacacataaatggggagaacaggaggattcatatgtttgttaaacaaactacaaaatgaaagataaatacaaatgaacttttaaaatatcactttaaggaattcttatttatcccttgggtaatgggttgtttttaaagcaagaaagtattattatctgaattttttcctaaaaggcaaatagtagccatgtgttgtatacataaacaggaccaatgcaaaggtcattataacacatgaggtgagagatgatgaatacctgaagctgggtattgacactggtaaaagttaagaggtactcattggaagctagaattgatggggcttggtgacaacatgaaaaattgaaagggagctttttttttaatgttataggctatttaaatcgattttattagaacacaaaaatgttatttttaatttaaagtattagaagtataattattctatagaaataaaaggcataatatattctttagtcacacatttatacctagactagtttcacgcatgagtgataaaggatgcattagccatattactgttcttcttgtgtttttgaaaccaagaaatattcagatttaagtttatacatctttaaagcataaaaaatgcaactgaataatttatgagcagtagcactgagactacttaaaaagaatacagcagtatttgaaaaattacatactaaaaatgcaaggttatatatgcaagaaaaaagacaaactcaagacaatatttcaggatctataaacataacagtccagttggaaatttccagctttaaatatgacatatgctgatgtgaatgacaatagaaaaaatctgaataatttagggacatatcaaggtcaaataactccctacttttccgccttttgtaataaattaccacctcacttttccagcagtaaaccaacctctaagtagaaagattctaaacataaacagataaagattatgtgggatgccctctctcaccactcctattcaacatagtttggaagttctggccaggacaatcaggcaagagaaggaaataaagggcattcaattaggaaaagaggaagtcaaattgtccctgtttgcagacgacatgattatatatctagaaaaccccatcgtctcagcccaaaacctccttaagctgataggcaacttcagcaaagtctcaggatacaaaatcaatgtgcaaaaatcacaagcattcttatacaccaataacagacaaacgcagagccaaatcatgagtgaactcccattcacaattgcttcaaagagaataaaatacctaggaatccaacttacaagggatgtgaaggacctcttcaaggagaactacaaaccactgctagatgaaataaaagaggatacaaacaaatggaagaacattccatgctcatgagtaggaagaatcaatatcgtgaaaatggccatatggcccaaggtaatttatagatccaatgcctccccatcaatctaccaatgactttcttcacagaattggaaaaaaaatactttaaagttcatatggaaccaaaaatgagcccacattgccaaatcaatcctaagccaaaagaacaaagctggaggcatcacactacctgacttcaaactatactacaaggctacagtaaccaaaacagcatggtactggtaccaaaacagagatatagactaatggaacagaacagaggcctcagaaataatgctgcatatctacaaccatctgatctttgacaaggctgacaaaaacaagaaatgggaaaaggattccctatttaataaatggtgctgggaaaactggctggccatatgtagaaagctgaaactggatcccttccttacaccttatacaaaaattaattcaagatggattaaagacctaaatgttagacctaaaaccataaaaaccctagaagaaaacctaggcaataccattcaggacataggcatggggaaggacaccaaaagcgatggcaacaaaagccaaaattgacaaatgggatcgaagtaaactaaacctacagaatgggagaaaatttttgcaaactactcatctgaaaaagggataatatccagaatctacaatgaactgaaacaaatttacaagaaaaaaacaaacaaccccatcaacaagtgggcaaaggatatgaacagacacttctcaaaagaagacatttaagcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcaatgtggcgattcctcagggatctagaactagaaataccatttgacccagccatcccattactgggtatatacccaaaggattataaatcttgctgctataaagacacatgtgcatgtatgtttattgtggcactgttcacaatagcaaagacttggaaccaacccaaacgtccaacaatgatagactggattaagaaaatgtggtacatattcaccatggaatactatgcagccataaaaaaggatgaattcatgtcccttgtagggacatggatgaagctggaaaccatcattctcagcaaactatcgcaaggacaaaaaaccaaacaccgcatgttctcactcataggtgggaattgaacaatgagaacacatggacacaagaaggggaacatcacacactggggcctgttgtggagtgggggtaggggggagggatagcatttggagatatacctaatgttaaatgacgatttactgggtgcagcacaccaacatggcacatgtatacgtatgtaactaacctgcacgttgtgcacatgtaccctaaaacttaaagtataataaaaaaaattatgtgtaaaaattaagataaattgaaaagtagaaaaaattatcctatattattttgagttgctgtgatatatatgaatatagatatgtttaataataacataagtattttactgcttcatcctgttttcaactttatatgatcttcctttagaaaatctacttttttatatatactttaagttctgggatacatgtgcagaatgtgcagatttgttacataggtatacatgtgccatggtggtttgctgcacccctcaacccaacatcgccagatattgtgggatctggccagcagccctcaatgcaatggggatctctctttgttcccagacagatcggcaggtcgagaaataacagacacacacaagatagtgaaagctgggtccaggggggtcaccgcattctggtcccgcagtaccaacaatgcactggatataccagcatttattactaagtttagtgagggcgcgggtaggttagtgagggatttagggtcatttcattatgaggtgagatggtcacatggggatgaagtaattctttaacataacatctgtatgcagaagtacagtatacagaggtaagaatttacaatatagtgtgtgcatcagtaatttctaacagagccttaaaacagaaacagtctttctataacctatgattagcaagatattaatcagcagtaacagttgcagcaaaagctggttacaaacaatccatagaagcaggacgtgaagctagacaaccagttagaccagaaattctcagaagggagtatgccttaaccctaaacagacctagaagacccgtggcaagatgagggcgtttatagccctatcttatccatatggacaggtgcccctcatgcgtccgtttataaactctccacaagggtcgcattccattcccagagctatgaacatctgcttttctgggataggaatcttggtgatgtgaaacctccctgactgcacgtccattcataggctctctgcaggcggaagcacatcacgcgctgttggctcattctggcagtccaacctggcattgtcttaacacaatcctgcatgcaattttgtatttacaataatcaggagcatttcatcttttattccgtagcaatagtttcacggggtctgcctacatcaacccatcatccacattaggtatttctcctaatgctatccctcctctagccccccagcccacaacaggcccccaagtgtgtgaggttcccctccctgtgtccatgtgttctcattgttcagctctcacttatgagtgagaacatgtggtgttcggttttctgttcttgtgttagtttgctgagaatgatgctttccagcttcaaccatgtccccacaaagaacatgaactcatccttttttatggctgcacagtattccatggtgtatatgtgccacattttttaaatccagtctatcattgatgggcatttgggttggttccaagtctttgctattgtgaatagtgctacaataaacatacatgtgcatgtgtctttatagtaaaatgatttataatcctttgggtatatcctagtaatgggatcactgggtcaaatggtacttctggttctagatccttgagaaatcgccattctgccttccacaatggttgaactaatttacactgccgccaacagtgtaaaagtgttcctatttctccacattctctccagcacctgttgcttcctgactttttaatgatcaccattctaactggtgtaagatggtacctcattgcggttttgatttgcctttaactaatgaccagtgatgatgagctttttttcatacaattgttggccgcataaatatcttcttttgagaagtgtctgttcatatcctttgcctactttttgatagggttgtttgtttttttactgtaaatttgtttaagtcctttgtagattctggatattagccctttgtcagatggatagattgcaaaaatattctcccattctgtaggctgcctgttcactctgatgatactttcttttgttgtgcagacaatctttagtttaatttgatcccatttgtcaattttggcttttgttgccattgcttttagtgttttcgtcatgaagtctttgcccatgcctatgtcctgaatggtattgcctaggttttcttctagggctttagggttttaggtcttacatttaagtttttaatccatcttgagttaatttttgtataaagtgtaaggatggggtccattttcagctttccacatatggctagccaattttcccaacaccatttattaaatagggaacccttttcccatttcttgtttttgtcaggtttgcctaagatcagatggttatagatgtgtggtgtttctgaggcctccgttaagttccattggtctatatatctgttttggcaccagtacaagttacctcacttgtatgtttattgcagcacttctcacaataggagatatgaaatacacttaagagtccatcagtggattattggataaagaaaatttgtacacataaacacagaccatgcaatactactcaggaataaaaaagaataaaattatgtcttttaggtggaactggaggccattataccaagtgacaaagtcagagacagaaagtcaaatattgcatattttcacttgtaagtaagaactaaataatgttaacagtgaacatagagcgtggaataataggcataggagacttggaaagtggggaggtgacgaatgagaaattaccaacgggtacaaagtacagtatttgggtgatgtttacactgaaggagtgaacttcaccactgtgcaatatagccatataataataccacacttgtgctccctaaaactataaaaataaaattaaaaagaagcagaatatgaaaaaattgacataattcatagaaaacactaaatattaatttgaggtacttagtttattaaaagaagatcttttcatacttgtttcctggtaatgaaaaaagtggatatacatttttccttgtgatattataattgtaaaagatgtcactacaatgataaatataaatggaaagtataattttccaattaatcatttataagaattgttttccataaggaactacaaagggactaaaacatataatttttttggttctaacacgacatgtagtatttataaacatgtagaactatccagttctggagaaagaaagtcattctttaaaatatgttttcaaattgctacaattttaaaaaaaggtggaaagacaattttcaatactttgcattatattttgtttgaaagatatactctaggctaattttcaactcatagagaaggtttatattttactttttagaattttggaaataataactgcaccattacattgtaagtttttgatcccttctttcatatggtcttggctcctgagatacctagatgctcagacatctattaagcaaataaataaataaataccatacacttcaaggtgagacaaagctttgtaaaatggtcttcataagtagcactacacaagaaaataatataaagcattctatcaaatttcccaataataacaagaagtcaaatagatttcatcgcttccttcctttcttcctattttccttccttctctttcttttcttctctctccagccttacttctgttttattttttccctctttcctccctttttcctctctcttttctcccatttttctccttatgtattctacaatgaatttatgctgcataattttacagttcatatagcttgtaactttgtaaaaatgaagaaaacatgtaggagagctctgatagagacacagccctcaaaagcaaacaatcttcttttttcctttcttttttttttttttttttttaagtcttgggccatagttacaacaaaactgtaccagtggtggtttataaaatgcaagagaaagaaagatgtttggcattttagggacacatttgctagtaccatcctgatttttaacatgaggttacaaaaaaaacctattttacaataaaacctgcagaagtcactagtctgatatttaatattagagaagtattaagatttggaaaattatagaatttcaagtataaagataatgacagagaaaattaggaaaggataataggaggagtaagaacttgcttttatgcatctgagtttagaaaatccatctgaatttttttaaaaagacatgaagtaaacgcaatgagatatggaagatcctatgtgtcttgtgaaataatggctcataagacactgaggaaatggtcaatagacaaatctaagcacccatctcagcttgcacagtacattgctggtttctatgggttgtcctagacctttgttttcattttaattgctttagtgtttactacttttaagaatgtcctgattttgatgctatagtcacctgatgaatacagaacccccacaaggaggatgaagaaagtagataatatctaagatcaataaaaagactgaaacttttgttctataactgaacatgattgtttaaaaattatgtataataacaaaattagccaggcgtggtggcacatgcctgtctgtaatcccagctacgctactcaggaggctgaggcaggagaattgcttgaacctgggaagcagaggttgtggtgagccaagattgtgccattgcactccaggctgggcaacaagagcaaaactctatctcaaaaaaaataaaaaataaaaaaatatatatatatgtataataaaacatatgcactctgtgtaaactagtatgtaaatatttttaaatttagtaacttatggagtttaatcatattgccatttgattcttcatattttttttttgtctcttgaagttgtgatgcaatttaatatttttggtgattgttaaaagaaacttcttcaggtatatttttaaaaagacaaatatttgcatttaaactaaattactccttcttgattataatttctaagcagagatcgcccttgtgtaatcagtagtatagaagaggctcaggtaactaaaactataaatatagttaacagtgtactttctggggtcagcctgcctgacttggaatcccagacccaacactgactggttatttcaccttctgcaaattgatgcacttgtgcaaaatgatgttaactagcaacgaggtaaaccattggcttgttgtagatttaaaaaaaaaaaaaaaactttgtaaaacccttagccatttatatttgtccatagtttgctctgctatgttagattgggaagacaaaggaaaaatgttcattttcttccttcaaagtgtttaataatctcaagaaaagacagtattgcgtaagaaaaattattaataaaatataaaatttgatataatgactaagagagaaaattccttaatctccctgataaagtcataaaaattttcaaaatgaaggagaatttgaggtgagaccagaaagcttaggaagagttgaaagagagcaaaggcaataatttgtgaaaaatatacattttacaagaaaactacatatcattcagtgatactgaaatataatatgcaagggcaaattaggtgtccatgtacatagaaataagtgttcatttagtttcttaaatgattaggcaccactgagaaattttcaacagcgagttatgtgtggaatattttaaaaatatcaacctctgggaaaagttaaatatagattgcaaaattagaagagacatggtatttatcacccttgtttggcaagattatgacaaataatattacagtaggattaataatatttcccgaaactctcagaaggtatatggctagtgaagagtagaattaaaacacaattctgttattaaactgcaggtgttctgagaaattctactgcatttattgaattttaatttgatatatacctcagatccaatgtaatcttttgatttttcttcatatatcatgtgataaaagagttttcagtgggaaaataggagaatggtagaagtcagtgaaggaaaaagagagaggaagttgggtcacagccatattaagctgatgcctattaaatatcaaggagtcaatcattgttatttttttttttactttgcctaccttagcaatgttatatctatatgtaactatttctacaataacattttataaatacatgcacatacaggtaatatggctctgtcaaaaagttgatttttttgttgacttttatagaaaactatctttatagtcaagtatgaagctatataaacatagttatataattacaaagtagcaatttggctattctatatcctgtgaatattcaaacacatacagaaacatacatggttctgtatttatagtgttaagaaatgacaagttaactgcaacttgagcattttactcaaatttggtctaaaataattattctaaagccgtatgaaatcccagaattcagctgggattagagggaatgatctagcttgttttggcaggagaatatataaaaggtaatataataggtctctttcctactcagcaatcctataaaacaaaacaaaagttcctctgcctgcagtagtgtatactgagatgaaagttaaagattctgttgtattcttcaaaacgactgatcttggttcctgagccagtatgcctgttctgattaaacattttctggcaaattctcagagatatatttaaaaatgtcatactcctggttaaaaaaaatctgtattatttatctaaacatctttatttactttaccatatttggttaaaaatgtaaactgattctaaaatacaattcgttgttttcaaattatattacctaaatatgctataagaatattagacaacttttgaagttagtaacttcgagctgattttaatcatttattttgagagtaaactatttgtacatttattcattttgtgtggttgttcttaacggtagtcttgattttcttagttgctatcattattacaaacctctttctctgtttttgataagctagattattaaatgaaggaaaattaatggaaaatataggggaagctaagatatggaaacctcttcaaattctcaattatataacaatacataaaagtatcgtataaattatctcactggtaaggtaaggcggtacttgagtcttgcacatcctaaaaatgaaatgctattttaataatgataaataattcaaagatcacttaagccattgtaaataaaatattaaactttgaaatgtattttatgcactgcttaaataaattgacaaaaatatttctaaagaaaatttaaaaatcatccagagtacttagagtgtagaattcttaatctatattgtttcttctgctaaaggtaagagctatcgaatagcatatgtcttcacttttaaaatacaccatattgaattctgtaagcttagtctggtttttgttaggataccaaaggcatgaaaagattcgatagttaaaaaattcaaactgcagccagattacatatattctgaggcatgtatatctcacatatatgtttttgtgtgtttgtgtgtgtgtgtacacatatacatataatgataattcactttggataaaaaggtatgttttgtctcttagttttaaaattattataattaacagtctaataattaaaatgatatagattaaaaagtcaattctcagtgtatatcataacgaatagctacttcatcatgtatactttagacattttaaaactattcttcacaagctaatgtgaaattcatgttaagtgcatattcacatcaaagtcacttttacattaagtgtttactgcaggcatgctttacaatgtccacatgatcatcaaggcttgagtgaccatttgaggtttcatcttgcattctatttgtgcaggtagtctttcagtagatctgacattgatcatctgtcaatttgattttctaatcttatgagactcattgtaaacaaaataactaaatgtatgcaggcccacagagaaaacacaacagctctgcattttatttctgacagaagcattcttttcaatcaagcttaaaaatagaagaaaataacagtatgttttcactttatgaattcttaccaaacgattgggtccgaggcatttagaatttaaaaacaactaatctaaatagaaagagcctggcttgtgaagttttaaaattagacgatggaaccaataacgagcatatgttaatgaagacatgaaatcatcacggcattacatctatcttagtcagagcctgtcagtatgcccattgcctaataaattgtatccctagtcacagtttataagacacaagaagacattttcagaacctacaaatgaagccaatatgtgacatttcaaaactgctgtactaccacaattagtggaaaatatacaaagtaacaaatacgacatttatttcacaaagagtggcttaaagacttgcctagctcatcagcttcctatgaaacattgtcaggtaatatttatgtgtgtcagggtgggagggagacggatatggtttaggtcagacgctgggggaaggaatgtattatttcaaatacggtatctgggaaatacttatttgtctgacaaaggtgcatcattatacataaagaatagttgccttcctaagcactgacacaaataaatatttatcttccgtacatagatgacttgcattaaaatttgtaaattttttattgcttaattgagaagcataatctctgaatattaatagacaacatggagagttaatgaagtttttgtcataatgcagtacatttctccaacattctctaataaaagtatttgtagctaactcaaaatactggtgggtcctatataattaatgcatcgattaaatatgaactacaggttatatcaataatataagactttttcttgaattataaatcaaaaagagataagagctgatgaaaactatccacatttacttttaggatgctaaaaaaatgaagaatgcatctagaaattgtattctatgtaactcagatggattctatctaactcagatgttatatcacatcttcctctgagtgttctcccacagctgtggtgtgcactactgttttttgtgaatttcaaggcaccttctggtttctattacatgaattgctaaaacatttaccatgctgcaggtgtctatacatgttatcctttgacttcctcatatacctttccttactaaaattctacaactttgcatcagcacagtgtttgctagttaattcttgaagttttttctaaaattccccacagaaaccattaaacatggattgtttcaccataagaaaaactaaagaatcaatcttcctgatattattcaaaacagattactttttcctacaattacttttctaaactgatacaacataatgtgtatttcttcaaactagtcaataagtagaacaaaatcaccagttttcacatttgattcagcacgagctttatttgctattcatgaattggatttacttcctatataaatatttctcccaatctttcttaccatttggtcaatgttaacaatggcacttgattcttgccaagtgaaaataattttaatttattatcttctacttgcatacgtattcgttttagatcacgtctatatttctgttttattatttttactatggctagatatgatattttggatgcttatttgtgcttataatgaagttgaagtttcacataattttattcctctttacaagtatttttatcaaaattatgaaaccctattttacatataattgaaaattgaaactaattatgaatttcccttacttaataaatatttgtcaaattttgctcaatattatggttcatactgggcaatggtaattacaaaacaaaaaaaaaagaacgatgcagaccttgctttgaacaagttcacaatgtggtagggaaaccaataagccaacagatgtaagtagtagtcatgtacccaatttcacagaaaaagtctgacatgaacatgtatagtagctgcagaataacctggtgtgtgtaatctattcatcctaaggcaaggagatttttaactgatggggtacttatcagcaaacagtcgagagagaagacatgaacattcttctgtaaaatgacaggaagcccaagtgctggaatgactggacaaaggaggtgaatggtgaaatatggaaagggacagtcctaatcaaagtcttattaatgaaggccatgaaccaaccaagctgagtttggattattcccttaaaactatattaaaacaggccgggcgcggtggctcacgcctgtaatcccagcactttgggaggccgaggcgggcgaatcatgaggtcaggagatcgagaccatcctggctaacatggtgaaaccctgtctctactaaaaatacaaaaaaattagccgggcgtggtggcgggcgcctgtagtcccagctagtcgggaggctgaggcaggagaatggcgtgaacccgggaggcagagcttgcagtgagcggagatcgtgccactgcactccaggctgggtgacagagcgagactccgtctcaaaaaaaaaaaaaaaaaaaaaaaaactatattaaaacatcacaaggatttatgaaagggagttaaataatcacattttgacttttggagagatcatagctgctcacaagactggaccctgggagaccaattaggaaaccatggcaataatccaagtgagagacaatcagaacttcaactaagaccgtgacagtgacatggaaaaaagagggaagcattttaatgatagatattaggaaacagagtctgcaagagcttttgacaattgggaaacagaaaagcccaggaatcaagtaggctacaccagaaatatccaaaggccaaatggggatactgtggctacatatatgttaaatattctatgttacactttaattattttaacttttaaaacttttaatttgtatggtagtattgatctaaatgtttttctttatcctacttctttaatattttaaattaaacctctggtgcgtaatattgagctataatatttactatattcattaagcctcaggcatacttttttacatttgccgtgtcagaaattggaatgcaccttatatttcttcttactgttaacatattaccagcaacacaaagcccatttcatgtttgggttttcccttatttcttaatccccatcccatctgcttcctttcacaggaaaccatttgtaatgtgtttgccgtacgttcttcagcatagatatagtcttgtaaaatatagtgtgggttttgtgtattttcagttccattaagggttttgtaaatcccatctctgtcctactttactcatccagccttgtttggggaccaatctatgtcacatatctggtttattgtttcatattgctatacagcatctcatagtgtgatttactgtattttattaatccattcttctggagatggatacacaggttgctttcaactccctaatgccatatacaccatccttgtatagatctttgcaataatttctcaggagtatatatccaggagaggaatacttgcctgtactttttaaatatatttcttcctcaaagagtattggaaaatttatttgactatgaatataaaaatatttaaaattattctcccattattgaataaatgggattgtggcaacaggctacctatgtgcataaaataacacgaatgtctattttactccttatgccaaaataaatcacagatggataagtattcaaacactaagaagaaatgaagtcatattaatactgggagaaataacatgggaaaattgaaaataaatctgtccatttttctaggttccctattatcatcctccttcacgcttgttcatctctctgcagtcaagtctcctcacacaactgccagatgattattttaaaacaactgaccaataatactcttgcactgttataaaaatctcagtttaaacattaacttgcactgcaatgcttcctgactacccagtctaaaataccctcccaggcaatgtcttctcaccctatttgaattatctggatagcttttattatttattattttcttccttatttatttcttgattttttttctcacacctctccagaaataaaagcttaacaaaattcacaatctttgttgtctaatttgtcactgttttctcaggacctagaatgtgcagggaatattaacagtgcatttgttgcataaataaataaaagggcatatacatatatatagagagagttttttggaacaggaagctttgtaatatcacagtttagaaatatttcataaggcattgagttgcattcttttaatacttgaacatatttctctgacttcagtgcaaacccacaaaggtagtatcggacatttaaccatcaagctgaagccaaacttatatttaacgagctaatatcaacatgttgtgccctatggggtaatgactgacatgtgcttaacaaatcgtcaccaccacagggtagggagatgattaggatcagttttctgccctaccatatcctcaatggctctcagttatttcttccgtgttttggagagaatatttctctactttgtttctttgactattttctttcaaaaataaaagaatctttttttctcattacattttatttgtaattgctgaagctacttaattttacattaattttcaatgtttcaaaataagttgtagtttatgaacaacaaaaaagctcactaagcttaatgacagtatttacactaatttgatgattggcttacttattttctgtaataaccaagaaaacagattagcttataaagcatataaggtggccaggtgcggtggctcatgccttgtaattccagcattttgggggacccaggtgagtaaattacttgaggtcaggattttgagaccagcctagccaacacggtgaaagcttgtctctactaaaaatacaaaaattagccaggcgtggtagcacttgcctgtattcccaactaattgggatgcagaggcaggagaatcgcttgaccctgggaggtggtggttgcagtgagaagagacagcaccagggcattcctgcctgggtgacagagtgagactccacgtcaaaaaataaataaataataaataaataaataataaaataaaatatataaggcagtgtataaatacatagatacatatgtgtgtgtgtgggtgtttgtgtgtgcctgtgtgtgcgtgtgtgcataatgatgattaattttatgtgtcaacttggctaggccatggtgccatagtatccactttttggtcaaacatcagtttagatgttgctatgaaggtaattttttagatgttattaacatttaaatcaggagacttagagtaaagaaaagtgccttccacaatgtgagtgagcttcatccaataactttaaggcttttagagaaaagactgaggtcctctaaaaagaaaagcattcagcctctaaactgccttccaattagagctgcagcattaacccttccctagatcttcagcagctggccatgcaaatatcagacatgccaacctgcacaatcccatgaaccaattccttaaagtgcctctctctctctgtctctcctctatctctctctctctatatatatactgttactctctctatatatatgtattgttactctggagaattctgactaatgcatgcacatatacaggcagatagatacataaaccataaacagatacatagaaagatacatggatagatagatatataataagaaaatatgtgagcaataattctttttttataaatttaactatgttagttgctaatttccagacttatatcctaaaatgtaaataatacattgaataaaccactttaatggttgcatattaacttataaaatagatttttgctaatattacatttttattgagaatatattcctatcaaaaatttgaatgagcaaagtgcattggttccatgtgtatttattttctacatataaaaattgaatttatatttatatttaaaaatattaaaattatctattatctatatttacattgaagttacaactctatgaatgataaattaatactttggaagtaatgaaagaaagctcctagaagaaatctgatattttgaactaacaatgtgagaaattcacattatctcaattaaagtattttattgatatttgggacatctaatgaccttctctccaagaccttgaggacagaaaaatgaattgtttctgaaaattaactgtaaattcattatgtaatggattggcatggtgctacaaagtcacttcaaagatgctgtccaagactgtcagatctggctgtaatctgttaaacacagtattaacatgtctggagaacgactgagcgaattgaaagtgggggtcgctgagaaggaaggtgaaaagaagagccatggaagcaatattaggcagagtcttcaagcagattctaaggaggagtaaacgctgatataaaaaactccactggaacaagcccagtattaaatatgccaccactgtgcatgtggatgctttgaactttctttgtgtaataaagcatgcaaatcacataactcataatccttaatatgtattgagttctcagctcacaaatacagtgcatagcacattacatacaatagtttatgtaagcttcaactcaactagatgagatgtgtactattgtctccatttcataaaaattatctccattttatgaaaattcacttgctaaaaactgcaaagttaatgagtaacagactaatagtcttaaaccactgtgtctgacttcagagcccatgctcgattactctgctaagctaatattttccagattcagattctaaattcaacaagttcagttacaattataattcaggtttacatttacttgttcaaagaaagaatgtgtgcttgatggagagtatatctcttcagactttgatgtggttctatttcttgtcacaaaataatagactgttatacatttataacttaatattcggttatatttgatttctcagtagctttcccaaatagataaaatataataactcaagaatagacaccttctattcatcagaaattttagttagcaccatgaatttagtaaatactattttgatcattagaaaatgcacttggtgaaaataagcataacactgaaagtaaaatgcaccaaaccttacacagcagtgatgcactcactctctgagttctcttggggcaaaacccagaatatgacctgaggcacattttctaatctttgtttcttccagttcattcaaagttgaaaattgttttcatctttattcagcattattttccagggttatcttctgaagtgttagttttattatatttaaaaatagaatttcctctgggaacacatggttttcttaaaatggtatttttttcacttttttatttcaatgatagagaagtgtaataggcatttatttatatcagttgggctagcaaaaacttgtatgattagaccaccttctccagtgttatatgggcaccataaaagttactatgagcctctgcaagcatacatgattttcattaagattattaagtggttagctcctgacaacttagggcactcacagggagcaattaactctttggctactgccatttagggcaggagcttggccagagtcaaagaatctgggctgcatagaggaaaatttattcatggagcagctaagcatagcttaacgtactcagggcttgttggccacccttccccagaaatgttttatttcttttggtcctttcctcttttttgttttccctaagttttttgttattgttttaaagatgctacagaaggggaaagtggaaccaagtaagtcaatacagttttgttttgttttttaacgcattaactcaatatttgttgaatgcctccaaatcaaggcttggtattaggttttagtaattccatggaaaaaggggcattgtgcttattccctatgctcacaagttattctctagttggttaaaatgcagaaaattatacaaattttgtctgtcatttatttatggcaactgcaaacatggaagtttcttcatggtttggcatttgagttcttgaatattgagtatagtcaggattaaatcaatatcaatgcccttttcctttctaaatagtaaaatgttgcaaacatttttgtttaaaagggccatttttaggccaattaaaactattaagttaaaaactgagaattatttttaaaaaatctgaattattaacaattgcaatttttgttgataataaaaacacactttatccactagtaatattgtatttccttaatcctgctaataatataaactgaatcattattacctaaatattaagttttaaataaaaacttgttagaattgataatataaatatagtatgaaaattaactgcaaagtaatatatatcaaaattaatggcaaaataatatatatcaatatgttgcatgcttcaatattcatttcatatgtattttagaaatcacatttaataattttaggcagaatgattgatagacatatactcatatgatatagatgatatgagtatatatatgagcatatatacacatgagtatatatatcaatagtttctaatattatgcaattaactttgaaaataacattaacctttaaggtaagcaatggtcccttattttaatattgtatactaagtaattacaaatagttcaacatacctgatttctgaaatatttaaataataaagatttttaagctcattaaagtcataagaattaaacagaactaataaatcttattgaaccataaatctcctaaataataagactggtagtgtattaataaggtaagagtgttggacctgtgaaacacctttacgttttctttttaaaaataaataatcacactacagctgttaaaaaatcatcatatctgatcagttgtaagaaaacttaaacaaccacgtacaaaggaaacactatcctcacagtgccattgaagaggaaaaaaatgttgatcattaacatgagaataaacatcacctccaacaaaactagtatgagtatctctagatttatggccaaaatcttttctaaacaaactgaaaaatcatacaatttcatttgcaattgacatttcatggccctatgtatatgctagcagacaatgggggaaaacctcaaaaatcgaaagcaatcataagtacttcatgactaaataaagattctctagcaatcccccaaatcctgtatctcaaaggaggtgaaaattatattatttgtatatccaaggaatataaagcacatgttgtttttgattcaaacagaatgaatatccttaagcaaatgacagagaaaatttagtgaaaatgttttatatataataagtaaaaataactggttaaagaaatgcttatgattataattagagatctttgtagttgtgttcagctaggcagtgtttttatctagtaatagaaaaataatttctaggtggaatcaagtataacttaccccaaccattagccaaggaggcttgcaaccctaggaggcttctgattacggttaatgtctggacatgcctagcgtgtatcactttgtttct

SEQ ID NO: 1369 - DNA, 244892 bp, Homo sapiens
gatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttg

SEQ ID NO: 1370 - DNA, 177217 bp, Homo sapiens
agacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatctagagtgagaaaaggaaaatgtgtcacggatttttcttatactgaagacatgaaaaataaaaactgtataaagttatataaataaactttattcttcatgcacactaacaaaccaagaaaatatggttctaagtaagtgaaagaaggattccctaaaacccaaaatatttccctcaccacctgaaactctgctactagatattaattcttttgaaaacatgaaagtttttgatcctcatgaaaccacattaaaaatgtttatttccctgaaagcctaagtgagacttcattggctaatacttttgtggggattagaaagacaggacttctttcatttacactggatttgatttacaatcaaattaatatttggaataaaaaatatttccactttctgtacacatttcctcccattctgttcacagaaggcaccactatgatcacatgcaattgcccactatcaaaggaaaactctttaagttacaaaaaaaaaaaaagtaaaatgaaggactgtctttatattacaattatagttttaaaagagcagctcttgcaggacactaaaaacgtgatacaactttctaacgtcatattgtcttatcgtagaaatacacctactataagaaagcataggacagctgtaacaataaagccacattgtcctaataaggttcctttaattatggaactcctcatttgctaaatccctttttattgtttggtactctggagtgccttgattagtatttcctacttcaggaagtgatgccaaggtgggagaagccaaaaaacacacaaaaaatccccaaatagataattgctatctgggacttatatgtgataaactttattttgcaatagctaaaccagcactttctcttccttaaacattttcccagatttggggtatggctcggttcatttattttctcaaacttacctctaaatctacctctactatgaagactccctagaccaaatggaaatgagccatagatttctactacctctgcccttaaaaacaaaaccaaataatatatattgtgtaattcattttaaagataatctaaacttttgagcacaaaaattgtctctcatgttctgcagaaaatatgtacataataatacattttctatagatattaactccatagaaaatatgttaatgaatcagaatctagattttcgcttgtttctctttcctgtgcaataaaaggatcacaaattcaaatgcctacatgtgtgaagggcacatgtaagacaatagggagcagtacggactacggtaaacaggagaatgcaatcccctctaaaggcattcaaattaaaataataaataagaactttgaaattcttcatagaccaaatttactccacagttttcaaattctacatatagtccagtgaaaactatattttgtcctgcttgtttagaatcataacattttctctctgggtaaccctgtgccttcctcacattgtagatacagtagcagattggcagatctctctttcctttgtgcaccaaatctgtgcacaagactgtagaatcaaaatgggacttggagttctggtttacctaccctctgccccatccacaggggtgctgagcagtggcctgggggtggtggtggcctcagatgaggtagtggcaggcagatcatcagcccacgttggctctggagccttatcatcttcatcctggtctctggtgacactcaactacacaaaaatattcacattttgtgtttctgataatatcaagtaaaaaaaatactagtttgcttttgggaacatataaagactagttcagccatgctgtgtttccctagctctctgatactaactatttcaaataaaactcaggaaataatgcccctcctctgtgtcatgcatccctcaatacccaagttgtggattttcccaccacttggtgtgggtgtatttctgtgtacacacacatatacacacatacacacacacacgcagcccacctccaggcacagatttttgggtgctgggacatccaaagcagatgtgaaagatgcaaagttgagaggagtttattttcattcttagccactgctatgagaaaataaccactcatttctttaacatttttatggcctttctccatttcctaacactagacgtcttaacaatatattccaaaatatttaccatgaactcagtcaattttgagattgggaattagggtagcagaagacaataatacagctgaaataaaaacaatagtggccactttttgattgcttacccaaatctcagctgcagacacctttgcctgctctattatcagaccccagctaataccaaatgctgtaggatgcttaacatataagatgctctaagaaatgtttgatatctaaagaacaaaggatttttgtttcaaaagcaaattttctggactaaaatttccaagtttcatccaaatttatgatatataacgaaacaagaaaggcattttactttttttttaaaaatagtgcctttatagtagaatgatttataatccttgggtatagacccagtaatgggactgctgggtcaaatggtatttctggttctagatccttgaggaattgccacactgtcttccacaatggttgaactaatttacactcccaccaactgtttaaaagtgttcctatttctccacatcctctccagcatctattgtttcctgactttttaatgatcgccattctaactggcatgaaatggtatctcattgtggttttgatctacatttctctaatgaccagtgatgataagcgttttttcatgtttgttggctgcataaatgtcttcttttgagaagtatctgttcatatccttcgcccattttttgatagagttttttcttgtaaatttgtttaagttctagtataaagacacacgcacacatatgtttattgcagcactactcacaatagcaaagacttgaaccaacccaaatgctcatcaatgatagactggataaagaaaatgtggcacatatacaccatggaatactatgcagccataaaaacatgagttcatgtcctttgcagggacatgggtgaagctagaaaccatcattcttagcaaactaacacaggaacagaaaaccaaacaccacatgttctcattcgtaagtgggagttgaacaatgaaaacacatggacacagggaggggaacatcacacaatggggcctgtctgtgggtgggggcctagggcaaggaaagcattaggagaaatacctaaagtagattacaggttgatgggtgcagcaaaccaccatggcacgtgtatacctatgtaacaaacctgcacattctgcacatgtatcccagaacttaaagtataataataaaaaatcatgtcagtcattcttgacaattaccaggagctagacaaatcttttatgggaataattatattcttttgcaaatttttccttggattccagctgtatgcaattgaatcagtcattcacctgagtcctgacacttggttatttatccttgcaagagtttctcttatttgtttgtttgcatttttatttatttaaatagtcaaatctgtgactgagatagttttttatgcttttttacccagggatcctggtatgctgtcatcattaactgccgtctgccagctaagctgttctattgcttttgattttttttgtgtgtgcatgcatacatacacacacaagagggaaaaagtaattagtactattactcatgtatgcgtattttttacagtgattaaattactatcaggtgacttagagcaaagatttttccatttggattggtcattagccctatataaagggcacacaattcaaatacaataggaaattttcactgtcccctaaacacaacttttggtacaagtggagacaaaactgtggattacttgaggttcctctttctttcagaatgatcctgtatgcagatacagcaatttgaatgtgaacttttaaaaataatcattatactagagaatttaaagctagaggaaaactttcttggtcccttattttcttttttattttttatagagatagggtctcgctgtgttgcccaggctggtctcaaactcctggcttcaagtgatcctccacattggcctcctgagctcagcaccgagtcccttattttctactggggggaatacaaagctataaatgattaagaaactttccaaaagttattggtaagctagtgacaaaccttcaggaaaaaaagtactggttttttttgcctgcatgtatttggttttaagcaacaaataaaagtttgaggagtaagtttatcaaacataaaagccaactgacattagtctacacttcagatatacggtctagaaggtgagactgttccattgaagaggcgggctaagcagcacagttttcttcaaagaattaactcagcctttaaatctttaccttgttcaagtcctgagtcctcaaaagttatattttacctcttctaagcttaggaatgtgtgtttccattctcaatcacataatcatttggaaattttgatatctgttaacattactccacagattccaagacaagcaaaattaactttaataaatgaaaataatttcatcaattttctggctcagtgagatgtcagattatttcaacaaatgcataattattacggcttgctatttttataatttccttaccacaaaagcaagcatgttaactgaaaggaattttagaaaatgtggatatcaaaaaaaagaaaacagaaatcagaagtaattctacctcctaaagatagtcattgttggcattcaggtatatttttccctagtcttttttctaggtgcatatccatttttttgttgttgttgttgttacaaaaaaatactgtatgttcagttttctatgctctatgctattttaaaaaatatactatattatgatcattctatatatttcaccatgactctataacatttattattattattttgaagacagagtctcgctctgttgcccagcacgatctcggctcactgcaacctccacctcccagattcaagcagttctcatgcctcagcctcccaagtagctgatattacagaggtgagccaccacgcccagcctcctccacatttttataaccttgtcttccactactcccagaatatctggtcaggacctttcattccttcttcctctctattctgcctcaggctctcaatatcaacccttccaccacagcctaggaaaagttggtctccatccgcaaaaccttctccaataacccagtcagtactgattctccccttctagatgatgcacagtaccttctgactcttctatactcagtgctgattgtgtagaatttaacctttagtcctatcctattgaagagtaacagaatatgcctcccaaaatatgccactttggcacattgattattttgaactgaaggcaattgagaatcagatataagctcatttgtctaaatgcaggacatacattcgtaaaggaatccctcctcagaaaatcagggtaatgactcgagaggagtctagacccttacttagcccagagatacaccagaggactctacataaaaaactattcactaatccttatcttccattaattcacccatatgtttaccttcccaccatctgctgctgtagaaagtcctttcccattgtcgtcactcctctaagctctattgttctttcgttaagatgctatataagaccaagttctaaccacccctttgagctactcatctccatgctcctatgtgtatatgctacatgttaataacttctgtgtgcttttctattgttaatctgtcttttgtcagtctaatttacaaggccttacctagctaataaccctaagatgggtagaggaaaaaaaaatttcctcccctccactatcttgtataatttcttgtttcctatatataaataccacttccctgataaaagaaattatcttttttctttcttttcttctttctctacctctttttttccatagcatagaataggcaaaaagtatccattaaataaattcacaatgggttaatctttctgttacactcgtcttcaggttgaacttaataaggatatgcaaagagcgaaagagaaagagataaatttgcattatttaattcctctagactttaacgtcatcatttttcaaataaaaaaaattaggccctaacatgacttccaactctaaaagttggatttaaccaacacaaacgactggcagaatacacacccaattcacgatagtgattgcctctggagagaggaggaaaaagagctctggagggaaaaagctaggactttatctgaagcaagagtgaatgaacaaatggaaacattggttacttctgggtggtgagtacgcagtcaaatgtttgtttctattcttgttaataaatcttaaatctgaaaacacaagcttgcctgtcaactctgcacatttctactccagccacactggcctgccttggaaaagaaggctagctccagctctaagcagggacaccatagtaaaaggcacaaatgagttgtctagggacacctgagagccgacacctggagtccagggctgctccgtgtagctggacaagcagacgtgttatcaccattctctttcagcctttgagctgatctttaaggggaggaaaacagactcagtgcagtatcccaagaacatgtatgcatgagctaagaaggattgctgaccaggtgccacatccaaaaggtcttttgctttctgatttccaaacattttccttgaatttattacccagaattttgcatatattacaaagtcttcaaatctgaacacatgtctgctctggatgaatgctaatgatcatctgcattagtgtttgtgttaagacttagcatattcccaggagtgtgggtcaaaatttctccaatttggctctggggattctactgccactgggctccacagccagcatcttcaaattgtctggcttctcaggagtccttcttgattgattctccccaagaatcaaacacacttctttgtcaggtctctctgcactcaaatacttaaactgaaggttacttatttgcattttaaagttactggggcctttaggaacaccttgagtttgggctgcacctctctggattcactgtggctttcaaaaagggtgtaatgcaggattttgttctgtttaaacctctcatacattagtgcagtaaaatagcctgcattctggctttacccagtaaacatttttgacagctgtaatcatatacttttagaacaggaagaacattctagtaacattctttaattttacagatgagaaaactgagacctcaggaaaataggtgattcccctaacatcaggcagctatgagatttcatttctaagatgtcattcatcatgagatataccataaattttaaaatagttttgaaaaaagaccacacacattaaatagatgcatcccaatttcagaaataataaaatcgaaaaactacagactttggagtcaagagaatagtccttagcttcagcaatgagaccacaagccaggtttcctgacttccaggtctagaatatttcttctagatcagttaggaatatgtttattatttttgtttttttcctcttccataacacaggtgcatgttatattctgagggtaacaagtctattagaagcaataaataatacttgtacagcaaccttttgtagtgatactaataattagttgttacgcagggttttatgaagaatttgaatgtttttcacgatcacggtgagagaatgctaattttatttttcgctaagaacatattttggtagaaagaagaagaggaaggaaggacagagttaggtgtcttaagggagtgacagaagggacaacagtgaaaaggaagagacaacaaaagggaaatggtacttctgagatcattgtttactagctttgcagtattgcctagggtaggctcaggaaggatctgagaataggaaggttgtaacagattcattttattttaaatgtttggatactgtaattatacttattaaaggtgggtgtgcatgcacagaggcataaatatgttcttgtatgtgtgtatgtatatactatgtgtgtgtgtgtgcgcgcgtgcatgtctgtgcagtcaagtgctgcataatgacattttggtcaaccacacacatacatgacagtggtcccatccgattataatactgtatttttacccttttctatggttagatatgcttatatatatagatacttaccactgtgttacagttccctacagtagtacagtgatatgctgtgcaggtttgtagcctagaagcaataggctaaactatctagcccaggtgtgtagtaggctatactatctagatttgtgtgagtacactctatgatgttcacacaaaaacaaaattggctagcgaaacatttctcagaaagtgtccctgtcattaaacgatgcatgactgcatgtcaaagatttaaatgtgaatagaaatgcacgtttgttcaaactaaatatcaataaggaaataattgtttaaaaattcagttttgcattggtgcttctttaaaaagagccagaatgagaaagcctagagacaagaggcactatccgagaaggtcaagttcattgcaaggtcccactatctgggtcaaagttcccctagagagacctagctgatgttcagtttcccttcatgtggctcttggtgttataaatccagagtattttggttgtatttttcttacgtcctcccctccccagctactagaaagcttcatatgtcctagtctgttaatgtcatttgtctctcaaggccatcaggcttcctgggatgtgatacagagggatctgttcttacttttcctcattacgtgtcataactgccttggatgtccctcaggcacctccactttacatggtgcaaactaaactcactattttcctttaaaaaaaaaaaaaaccaccctgccttttatattctccatctcagtatatagtgtttcaatccatctcatctccatgctagaaacctgacagtcctacccaaacccctccctctccctcacctccaatcctttcaatcactatatcctgttaattctaccctagaaatggcttttcaatctgtgcctcctttttattcccagtgcccctgccttctttcagggcctcattatcattttcctggactatcacgcctcatatctcagcctccagtctcctcacctcctcctcctaggtatgtttcacacagcaatcagggttattctttctgtgaaccaaatatgactatatgattcttgcttttaaaactcctctgctgtctctgcctgcctggcctatagatgaagttcaagctccttgccttaatacattaagacatttataattagtccttaaattacctgtccagctttagctctcatcactctgccacccacaccctaggctacaattagactgaatttgttcaactttcttgaaatgccatggcactttaaagactccctttgcctactgttttttttgttttttgctaggaatacccttccccctgctcttctcttgaaaaactcctagttattcttaaaacttgactcaatgtcacctcctctgtgatgccttatgtaatgaactaaatgtttatgtccctccaaaaatcatacattgaaacctgaatccccagtgtgatggtatttgaaggtggggactttgggaggtgattaggtcatgagggtggagcctttatgaatgggatcaatacccttataagaagtgatgtgagagatgagctgtctctcagccatgtgaagacataacgagaaggtggctgttcacaagccagaaagcaagccctcaccaaacaccagattttagacttcccaacctccagaactgtgaaaaataaatatttgttgtttaagccactcagtctatggtatttttgttatggcagccccaacagactaagacactttcccattactcttccctgaaattaattgcatcatctctgtgcttccttcatagctctggctaaaattcataatgcatcttgtacttacctatctccctgaaaaaatgtgagcttctctcaggcaggagccatgtcttaagagccacaccatctatcacagcagttaataatcaatacatgctattggaattcattggtattaatatagcaaaaaatgtgattcagtgattataaggagggctcagtttaagcatcaattcctggatgaaacctgagcttgctcttgtttaggaaggctttagaaagggatgttgattgactaggagagggacaaagtggtaagtcacacaaacaggagaggccccagtagcggtccatgctcaggaggagatagactgtgtccattattgtctggaatttactttaaaatgcacaatatagatcagggttggcaaaccactgtgggccaaatctgagtcactatctgttcttgtgagtaagtttcatcagaacttattcatactcattcatttaagtattatctatggctatgtttctacttcaaacgcagagctgagtaattggaacagaaatcaaattacctgaaaatccaaaactattcagtatatggccctttacagggtttgctgacacctggtatagaccatggagtataaatgtttgtgttaatttcaatctgcaatttagtagaatctattgccctgactggaattacccattttgcagttggttactatttaatcaaatagaaatatgttagaggcctttctgcacttttgtgaacaggatacgagaatctagtgagttctatagcctgtgcccttaggaatggtatcctaggcctgattcctgaatggccctgagtccaactactgatccgaatgttccttagggccttagtctaagtagactgttagctgaatcctgatgttagaacactgttgcacatgctcatgatcactctttcatgtacatgaaggcttcagaaaagggcaatgcaaggactttactgagcttacagaacaggggcatgactgttatgtgcctgcttgccagaggatgtccatggggttaatagaaatgggtctagacttgcccaagttgcaacttggtggagaagagactatagcactcatcggtaactaaaaaaggctcccccattttctccttaaaaaaactaatatttgcccataatctgattggctgaagtcagttcccagaagcttgctatgaggacagtcacatttgtttcaattgattcaggaggtggttcttcacatactatgtgattgaggagctctgaaacagagcatctactttgcaccatatgcatatatagcctccctcacagtcctcactcagagcacaggaggtggaagccaaatgagcaaacacatggcttggagtgtgggagagtggccagttgggcatatgcgtatttagaaaagacatgagagggtacaaagtgggaagcagatgcacagacgaagagggagagttgtggcctggtatgaaaggcactgcacagcatggcaactaggtgaattcagagtgttgtgttaatctgtttcagcatacatggttactttgatggtaataggagtataatataaaaatattatcagcaacatttaataaatacttataaaatatgcaagtttttaaaaatatcctacaaaacctaatgctatttcagaactggaaatctagagtcaagatactaacatttagagccaaggacctaaaaatacacgtgcctcagctgattcttgacaatgcagggcagaatgatctttgatatgaaacagagagaatacaccattttaagctcacaaagtaagtgagacagttacttactgactcagaaatttctttttgaggctctggagtagattcactgagttcttcccctgacatcccaaatccaggttgaggtgacgatgaaccaaaaatttgaacgagataggaatcaaaatcctcacaaattttttgaaacaatttttgcttcagggtgtcttttaaaaaagaagtagaaaagagagatagtagaagcaatgaaacaatacttaaaactcatttaaaaagatctgcactctccttaaaatatgtaatttcccattacttgaaatcaactgctaagttaacgaacttataaaagcatttttacatcctgtgtaagaggtcatctaaaataatatatatgacacaaagaggcaaaagaatgacttgaatgtatgttcatccaaagtgtctctgttcaacgtgaatcactccttgtcaagagctagcctcacccataataagttgaattggcagctacctctggttttaaggagagcaaatggccagccagttgcaaatattctttacaggctgtaacaaattactaactccagatataatgataaagctcttcaaggattaaaatataagttggctctgaaatgtctttggctattctgacacattcacagctgggtgagattgaatatatcagataaacaaacccaccagtcagccagcagggtactgatgaagtagaaccctaggttagaaagctctggagaaggtgagaaatagcaaaaaagtttctgagaatggtatgctttccttagggccagtgtgctggtacacggcataggcagggcatgaggcactgatgggctgtgcccagccacatcagactccactcccaggtgggtgaaggaggaaggatgaagccaaactgaagcctttcacttacttcacaaacttgccaggtacaggcctgccagaatgaataatcggtttccaaagaattgggataaattttattataaagtcatactgaccataatttaatcatagcttaaattagatcaatgtcctaggatggctcattagtaaatatcagttaatgtgaaaggataaacttagcatagagaagcccatcagattagcactggctgtacaataaattctatttattttttatttattttttgagacagagtctcgctctgtcgcccaggctggagtgcagtggtacaatctcggctcactgtaacctccgcctcccaggttccagcaattcttccgcctcagcttcccgggtagctgggactacaggcacacgccaccatgcccagctaatttttgtatttttagtagagacgaggtttcaccatgctggccaggctggtctctaactcctgacctcgtgatccactgtgcctggcattgtacaatgaattttaaaaggttgttctttggctgggcacggtggctcatgcctgtaatcccagcactttgggaggccgaggcgggtggatcatgaggtcaggagatcgaaaccatcctggctaacacagtgaaaccctatctatactaaaaatacaaaaaattagccgggcatggtggcgcgtgcctgtagtcccagctacttgggaggctgaggcaggagaatcacttgaacccgggaagcagaggttgcagtgagctgagatcacaccacagcactccagcatggtgacagagtgagactccgtctcaaaataaataaataaataaataaataaataaataaataaataaatggttgttcttttgagataaattcccgatatcaacctgtttattcatcattatctgctttcataaaaacagagaatagaacatcccctctaattaatcccagttacttgcatttctcatctctttagatgaccataacttttttttcattcagcaggtacttcttaattcattttgatttcctgactgttttctgccttgctgttggcttgctcgatcccttattttagttaggtaactttctgaacattaaccaatgttagcaatactcccaagtcctattctttctctccattcctgtctgttgaccatggactctagttaactccaaggccaactcagcatttattaacccttaataaagacaagggattgtaccctccaaactgaatgatattaaacatttttaatcttctggagtttacgtgttaccatttaatgttggcataagccttattagcctccagatttttctatttggtcaggacaaaccagtgatatggtacttagaggaacaacataaatgcctttcccctgggccagatagccttccttaccttgcagggtaaagaaatcatcaaactggtaaacatgctctgggtcagtagcaattagattcatttctttgtggaatatttcaaagttgggatcatttttcttcaccacccctatcacaaatatctccacattggtgtcactggcattcttcaccacctctgtcagtttctctttatcacgagaatctgtctgtccatcagtgatgaccaaggccactttttttacacctggccttgcatcttcaaacatgtcgttggctgcttgcagagcagtggctgtgtatgtgccttcccccagatactgcatgttgtccacagccaacttgaagtcatccttgctggagaactgcttcaaattagccaccttctccaccttatggctatagttgattatgcctatgcgggccgtggcaaggtccagagcaacccggtcagccatagtcttcacaaaatttttaatgatctgaaagttctctggccccacgctttctgagctgtcgatcacaaacaccagctctagtggagtctctttgcatttgggcccacaacctaaaagatgaatgttgagagagaaaaattgtgggaatgattgacatcagattgttgaggggaggggagaaaaagtcaatgatgaacctgagacctaaactattctcttccttttctgtgattgtgaaaatacctgacagctgtctccattctggtttctttttttttttgtgagacagagtctcgctgtcgcccaggttggagtgcagtggcgcgatctcggctcactgcaggctccgtcccctgggattcacgccattctccagcctcagcctcccgagtagctgggactacaggcgcccgccacctcgcctggctaattttttgtatttttagtagagacagggtttcaccgtgttagccaagatggtctcgatctcctgacctcgtgatatgcccgcctcggcctcccaaagtgctgggattacaggcgtgagccaccgcgcccggccccttctggtttctatacttgactcttaaaaaaaaaaaaaaatatatatatatatatatatatacttggaaaaacaccgtagttgataaaataataaatacttatgtgctcgtttcttggattataaaataaaatatttttaaaagagttaggatgccctgtggatgccgtcccaataacattcctcttcctctcccagagaggtaaccaccatctgacatttgctctttatcatcccaccattgtatttaatctgaatctgaaagctgatatttcagtcttcaaccatagccttatgtgaaaattgaaatttgctcaccaggctggccaatggatgaagtaatgggatgaaaaattgtcattgtggtagaaggattgggaccttaaatgtacacaggaacagctatccctaactactctagttgatgtctccagtcacccacaatgacaactatggcagctttcacgttatcaaggaggccagcagtacatccatgctatgaaagcttttgaggggagtaatccccgagaacactagtcaatttaaaaaaaccttccatttaggttgataaacaaccacttaaagcagttgccagagtcatcaggaaatataaattatcaggattctgtttctttattcatatcttcctgttgttcaacaagcctgccacagaaaaccatcaggaaatcatgtgctatttttatagggcttctagaacccagaagccatgtctagattggtctctcactagagagactcccaggctgcttcttaggcccagcagtcttttagggaataagctggttctgggattctctgtatagaaggacaatatgcctgcctctgaccactttaaacccagaagattctcccatcattattccattagtctcttgtcttttggctaatttctttacttcctctttctggtaattctaagtctaccattcagtcatggaagcatttagtagttgtgaagcaaggtgaatacctgactctgtcctcccacctttgggactgagtacaactcaaaactctactcagaaagaattcatggcttcgggaaaaacacagacattctaatcaccagctaggctggactcaaataccagtttggctcttgtagtcatatttcctttgttgagtttttcgtctcagctcaggtaaatgtcactgaatacaaacgagcactgtgctaacaaaaggcccggctgcctacataccctaggctggcaccttcacatgccttaaccagcctgggaagatgattttatttccttacatcaggattcccacagtctctcttactgcttcctttcagtttccatcgacttttcaaatgagcttcacattttcccgctagctatataatatacatctggacgaacacattctgtcaccagcacagtacatagtggggctgatgctttaaagtgatgttttttccttgatcaaatcttaccacatatttctgtaataagtttgataatttcttctttctaggggataaaaagaaaaatgtattactatatgtatgactataatatttttcctagagccataaaagatatctcattacaatcagcactggaccatttgatttaatccttccactgcagaaaataaaataaacaacacagaagtcaaaagctgactataatagaccataactaaaatgcgtttgagctgtgaaacttaacagctgagacttttggaattcaaattgcaactgcagcatttatcagctgtgtgacctcgggcatttggtgccctaacagtatctgtgtctcagggctatggtatggattaatcaatgttatgcacacattagcacagggtctggcaactttaacatacctacggtgctgtggtgctatatatacattcagttatacaatttaaaccacatgtgctgagcaaccaagacaagccgcaatgcctacagagaattcattctatgctgtattttctcttctttttctgtactagttcctgatttttcaagtcctctcttcagcttcttaacaccctcactttggctcttctgtgacatttccccatgttcctgaacgcccttttcttgtcctgctgcccacaagctccatcagaagggcctgaaatgagctgggtactagaaataaagctgccaatgcccttccctgtgcagtgtgtttataagtaactacaatgagactagagaaggcaggattccacatttgccaaacacttaaagctaaaagagatgattaacagaagcctagatctcaacaggaaggaccagtggacccaatctaagaaaataaagtttaacaggtgcaaaagtaaaatttttaagaacaaatctataatgtcaaatcgaggtggaggtgatgtagcctgtaacatggcttaaaagtagaatatgtggggaatattcatagtattttaatttaactttttaaactgtaaactaagtaaaagctaacgattccaagtggctatttaaaaagaacatctactgcagtgctgagttatataatacaattctacaaaatgagagtcaacagtcttctttttttctaggccttgtcatgcttttccgcatttaaaaaggcatttaaaaaaatccgaaacaagaacatgtacagaaaggtaaaatgtatgtatttatatatttatattaagtatatctagaaaggggaaatatatgtatttatatatttatgtttaattttttataaacggagaaaatacaccaagttttatggttataatttgtcacctaatactatattataattcattttccacattattaaggattctgaaaaacttgattactgaaattgaatgtgcggccatttaaaggctctgcgatacacactctcacactgtactttagaaaagttgtgctaactgacacctccaacagcagtatataagaaaatctgttttattttagccacacaatactggctattattattatatcatcactgtcaattggtagagcaaaatctctcattgttttaaattacacgaattaaattattcatgaggctacatttcatttcatatgcatgtttccaggttgtattctcttgtgcaatctgtgtatgttctttgtcttatctttttctatgggaatatttgctttttattcacttataagagcaatgcatgtatcaaggttagattttaattttgcaacatattttgtggcataatcaggtttaaaatgcttgaagttaccatatatgtaaattttttcttcatgttctttgcatttaagtgactggaagagttcattccttccactgaaatcactgaataactaccttggctacttggtgccaatgatgaaggcatcatatttatacccctcaaaggattcacagtccaggaagaagcagacaaacgaagactttcataagtgctatggagagccaaggaaccatctcgatctgctgggaattcctggggcaggaaactgaggatgggactgtggtccaaggaggcagactctgaccaggctgggacagggaaggggagcgttcaggcaaggtggtcggccttctgtcagagcatactgcattacagtactcgagtaaacttatgaattagggcacatagcagaaacaatgacaagaaatgttggagacagatggactcttgaagacctttgtgtcatgttgaagagtgtgaactttctcctgggcagtgggactcacatgatccctaggcagagaagagctctggtggaacttttatttaagagagatgatcatagcagccagtggaggggtttgaggttcctcaataattcacgcaaaaaaaaaaaaaaaaccagacatcagaaggctgtggtagtagtaatggatgaggaggacaggcctggagggacattccagaagaagaatgaggggcttggtgaataactggaagaaacgatgagggaaagaaggagtctaagaggaggcaaatgacagtggggccatactctgagagaggcaggagtgggataggggcaggttgggagctcatgaagatgactgagcccagcttgagtctggctgagtctcatacgtctataagacatccacctagagatgtccacgggcagccaaggatgtaagatctggcgcttgggagaattgtccgggcaggaggcagatttaagaaatgccaatgtacagttggctgttaaaacagggactaaaagtaagattgcctagaacagggctgctcagcctttttgaaaccggtgtgtttctccttccccacatttgataaacacattctttctgcttaaaataaaaacactattttttcattcactatatgctttcactgtactatagaattagccttttcaaactatatgtccccctgcctttagtggctacattccctgagagtttgaagacagggaagactggggccagacaccgggaaatgctaacaccgaagtgacatgtggagaaacagagtcttttcaaataattttatgagatgtattaaaacatttagtgccatcaatggcatttgcctcttaaaagaggagtttgttagtctgaaatgaatctgcacaattgatagctattgggggatacattcgatcacagaaaggataagagggggagaggaaagaggccttctgagaacagctttcatgggggagcagcctgaacttggtatcagacaggccacctctagctataagggctctgctacgtgccagctagatgactttgggcgtaatgtccaacctgacttgtgtgtctccatttgatgtggagatactgtctacctcatggagctgtcatgcagattaaaggtgggatcttaggtaagagaaggttatggccatcagcctgtcaccgtcttcttgtaccacaacccactagtcctacactgcatgggggtttggccagcattcatgctgtgaaccagtcctcatttccaagctctgtccaaatcccctgaaaccacctgctgtttggccacttcttggctgggcccatgcatccaggccagtgcttcagctctccaaacctgtggccatttcaactgagaattctggaattgcatgcatccagagtgtggcatagaggaacatatgtgcatgccctttggccccaaggacttctaacctggaggaaggagcgcagctggagaaggacgagggttccagagcgggggcctctaaaacaccctgcagtactaggtaaggagcctaacatgtactgatgtacaggagcctaacacagagcctgtcacacactaaattctcacttaatgcaaattctcttttccttcactcttctcgtcttgctagtctcttcttccagaatctagaaaaccaaagtcagcagaatgatgtccctacttctaaggtctctgcctcttggttgaaaagcttccactcaagagataaagcctatcctgccctcaaacaccatcatacaccattttgtctgctctggaccccgagaccacatcttctatcatagcatttatcactccgtaggtgaacatctttgttgtctttctctccaccaggctgtgagctctctcagttccaagaagtagcctcactctccactatttccccagtgcctattttggagcctgatccagagtaaggtttactggatacatccaataaaggttggtgaaatgaatgaatgaataaatgaatggagaaaggaaaccagtccctctccccacgttgggacagtagggcaggtataaacctacagggaacgttcctctgctcatttacatacactctcccctgctacttttggggagaaattgtgcatatgtagctacttcatctactatgggcatctttcggggtctgacttgtggtggggaacaacaaagagaaaaaggcagacagcccgcagaacacatgtgcagttctgttggtcacatgcccagctctcagctcttgccttcaccacctgaactgccactccctcacacttggatgttcctagtacatcgaatcagccccgctagaccacaaccctggaaaagtctaacaggaaaaaaggaaaaggtctgtgattttcctcaaccccagaagacagattgccttcaaagcagaaaggaagaatgagactttgccttccactcatgagactttaaagagtcagttttctgttcttaatggtgtggggagaagaacagggaaacgtttatagatgctcagaaaatacttattgaataattgaatcaatatataactataatctcaattttgtgattgctgctcttctcagagcacttctaaaggaactagttcaggaaaaaagagtcctcattctaaaatgagacgaaccacataaattaaagtcatttggtaatctggcttttttgaaacagctcacctccttgttggccagtaacagcagtgtgatcatttctaccaagcatccgagtggagtagtcacacacacccaccacaaggcaggacaaggttttatctctcccctcatagtcagattcaattacctcatgcatctaagccaacactgggctggtagtagttgatctcatttaaatagaaactgggattctgcatccaaaaaattcataattctaaagctaaagcatgaatgcaacaattttgcaagcacaaaaccctcaattaccctctagaatggatactcactgtaagtcctaggtctcctttgggtccttgtaaaccctacttagtggaagaagagtaaaagtcaatataggttggaaccagttagagtataaaatcacagtgagacattaaaaactacttgcctgttttcctggagatccaggctctccaatttctcctttatcacctttctttcccacatcgccccgttctccgtgctctccctttacacaatagggtaaaatgataggttcagaatgtgaatctaaaagccagataagaaaagctctataatttggttatctgcaactggcatctcttgaagaccttcagttcttgtttatacaaatgcagtatttgaaaaaaaattgggggtaacttatttacatcccatcagataccataatctaattcatgatgaaccagaggtctcagagtgaagagaccttgagatataataccatctaatcggctcacctttcaggacatacaattattacacaatttaccgggtacctgagttatctggtatctcctacatggtatgttgtaagtatgttgtaagataactaataaatcctttattagttatcttctgagaataaagaaaatgagatttttttaaacatagagatgggatctcactatattgctcaagctggtcttgaactcctggcctcaagcaatccccctacctgaagctctcaaagaaaaggacattttataaagtgaacctatttataggtagacaaagcaatgcacgaggattttattttgagtggattgtttttcttctgagagttgtaaggggaagagtgacacatatatgagagttcttccaaagttaaagttaagctattgcgatcctaagcctaagcatttctctaagatcctgagacacttaccttctggcctgggaggccatggcccattgtgccctttgggcctgggaagccttgtggtccttgttccccctacataggatatgagaaagagatgttctattaatttcccaggatagcttggctattctttgggtcagaaacacacttacggtttaaaactgcattatagtattatctaaatattaggggaaatatatatatatatgtatataaatacatatgtgtatgtgtgtatgtgtatggctcaatggtttgctagtaagtgtttaacaactaagactaggataggagtgagggctctgatttatgccatttgcctatttctgtggtgtaaatactttcactgtggctaattcaagctatgaacacatcaaccagttcacacataacagatagctgctatttcagctatggtagtaaaggtgggttccatcttctttacatttttccatgttttctggtatgttaaaaaacacatgttattggctgggcacggtggctcatgcctgtaatcccagcactttgggaggctgaggcaggtggatcacctgaggtcatgagtttgagaccagcctggccaacatggcgaaatcctgtctctactgaaaacacaaaaattagctgggcatggtggtgcgcacctgtagtcccagctatgcaggcgggtgaggcagaagaattgcttgaacccaggaggcagaggttgcaataagctgagattgcaccactgcactccagcctgggcaacaagaatgaaactctatctcaaaaaaaaaaacagaaaaaaaatgtcattttagtaacggggaaaagagtatataacagcatccatccacaattaatgccaagttattgtttatgtaattccctttatactgttagttccatctctcataatttgtagcaacattcaggacttgtttccagatttctccatcacattttaacattatttcttgccccacccaaaccacacagtttccaaggggtttcatggtgttgagcatgaaacagaaacaatcactagcaagtatacaaagtcatagttctaatgctccttggatcttatactcaatccttatttgactctggataattattagtaatgagtctctggcaaaggcttgaaggaccacgggctcctcgggattgatctgtggttttcaaaactatcctgatcatccccaccaagatcattggcatgcttgataaaaattgcatctcccaggcccaacctcaaaccaactaaatgagaatcacaggtgaaggtaaaggcaaaatatgcattttgccataagtctgctaaagcttgagagccactactccaggaggcatgatgggatttacgaggcactcctggaaggggccacagaggtttgcttggagaccattacaactttgggcacctcaacatccctaagcctcctttaccttgttcattggctgtcaagctgtttcaaatcaaaagggcctattctcttttaaattgttataatgaaatatttcaaaacaaaaatcatatagaataaagtaaacacctatctaccacgttaaaaaataaaacagatacaattcaaacctcttaggtactcatccccaatcctatttctctgagagaaaaaatctctatctgaaattcatatttatcattcatatccatgtttttatgctttaactacatttcaaaataatacatcttttttttgttgtgtgtgtgtgtgtgtgtgtgtgtgtgtgtgtgtgtgttttttttgagacagagtctcactctgtcaaccaggttggagtgcagtggtgtgatctcagttcactgcagtccccacctctcaagttcaagcgattctcctgcctcagcctcctgagtagctgggattacaggtgtgtgccactatgcctggctaatttttgtatttttagtagagacagggtttcaccatgttggccagtctggtctcaaactcctgaccttaggtgattcacctgcctcggcctcctaaagtgctgggattacaggcatgagccaccacacctggctgatatttttaatattttaaatttccaataaatgatatatttatgcatccaattttttaaaaaaacctcaatattatctatttgaaatttgtgtgtgtgtgtgtgtatatatatatatatatatatgtatatgagattctaatttgttgatcgtctctctgctataaagtatttcattaaataactgaatacaacttatccattagccttctgatgcacatttaggttatttccaatatttctgtattaaaaataatattttaagaatatccttttatatgcctttgcacacttgtatacattcctaggaggaaactcttacatcgaaacaaatattatataaaatggtacaaaataaaatgaacacagcacagattctctgaagctgaactaaagggctccatttttcacacacccatccctaacctctcacggcacattggcttgactgaactctaaggttctttttattctcttacatgtgtttctaaactgtttgtaggtatggtgttatggtattgcctccccagttcaacaccagaggacttaaaataagttctttacaggggtgagattacagagaacttaattcactgaatgtcttttcactttggtatctcttgagccaaacccagtgcagtaacatactgggcccactggaaatgggtatgcagtgttgcactacaatgtcttgggcccacctaaggaggctcacccagaagaggagtgcttcctctgttagttgcttagagggaacaagtagggatgattggtcttctttattcagtttaaagtcagaatagaatacagtagtccccctttatctgtactttcatttcccatggttacacttacccacagtcaactgtggttggaaaataagtgagtatagtacagtaagatattttgagagagaccacattcacataactttgatgacagtatattgcttatagttgttctattttattatgtgtttgttaatctcctactgtgcctaattttaaattaggccttattataggtatgtgtatatagaaaaaacatagcatatttagggtttggtagtatccaaggtttcaagcatccactgggaatatcggaacatatctcctgcagataaggagggactactgtaatcttttcccaccaggaaacttgatatcattgggagccccagaaccctggataggaatttgtaccagttaaataaaccctaaacattaaactgacactggcattccaagatgaaaattcaatcaaaaaaaaggagaggagaaaaatttgtcctgtttccaaagatggcactcccaacataggtgtcatgaagatgaataggtgggaaagtgtagataacacagaacagcctcatgaggctccctgcaaaacatgctctaataggagtggatctgcagcctgcttctgaacatgaaggttagtggggtctgcctacatacagactagcagccagcccccagagtgatatgcaggactgcaggcagctacctgcctgaggttataccatcttcttctgttcaaatcaaaaggaaaacaaacgcaaatagtataggaacgatatctcttaagaaagatgtcttggtaaatcacactttggtataaatttgttttctcagattttttgtggaggtgaatgaggacattttcattcaatgaggtacctggtagaaggtttgggttgcaagggagatgcgtcagaccgctgtacctaagttagggggtacagttggccagggataagacagactaaaggctcatgggagaacactaagaggaaatccatggttggctttgtctcagcctgaaaggacagaacagtgtgataaacagaggagctgagactgtggtgtgatggtgaattatcgctaggagttatatgtttagacaaagtgaatccagaaagaatgccatacctttctgacaattactcagaataattatttcttttgcaatatttcagattcctccagaagatgtccaatacatgttcatgactaactagctgcctttaagaaatgacacaatttcctaatatagctaaaacctactgttgtaaggggaagcatgacacgtgcctgagggaaaaaacattagagtagcaaattatcttgttagggtaatgttcaggaacttcttttgcattacttcacaatgtaagtattttctatataactgttaacactatagatattccaggcagctagatttccctataataaaggcaattcattttctttttaatcactagtttcccttcaaaatacttaaaggcttcctataactttcagagtagactatctagctaaaagcctttagcaagtaaatccatgtctgatcttggcagaggtgaatgctatccaatcagacttttcaatgtataagtctcaggaaaatgataaacaatgatttgagtgtgggtcagaaacaactgcaggaaacaacctattttattggaagctataattaaatctaaatttcaaaccctggttaatcactatatcaccacattagatgggtcctgataaagaagtgatcattttcatttttcagatgactgcttgttctctgggagagaaatttctaagaataatgcacatctacctgaatgtttccattgatttatttgtgcattactgatacgtcaggaaacaatgatttttctttcgaaatgttttctcagtaaggtgtggtaagaaaaaaatcaaatttatagatgatcataaaatgtaaaatggacatctggcttctgccagtgtgtagaaaagtggaaaaaaatgctactctcattcttaaagccccaacaacaaaaaatgagaactaatctgtgaagtcacagcttttcttgaatccatcatagagctgtggttgcagggcatcccgccaattcagcatctaaggaaagtcaagatccttcaaggagacacaggcttggaaattcacctacctggtggaggtgccacatgttatacaagctggtgagaatttagctaaaatttttaacaggatgctaaaggctgagtgtgggatagcaggaggggataggacccctgggagctgcaggcacaagagaaaatcacagctactcacagactcttctcagggactttgctggtgctcaagagaaagactggggccaggactagggtcaggagtaggcttcccttgtggtgctagcctgggaagggaagcacaggtcccacaggtcgcagtctgtttgtgctgctataacaaaataccatagactgggtggcttataaacaacagcagattatctctcacagttctggaggctagaaagcccacgatcaaggaattggcaaattcagtgtctggtgagggtccatttcctggttcataggtggcaccttcttgccgtgtcctcacatggtggaagggacaagacagctccctggggcctcctttataagggtgctaatcccattcctgaggacagaggtgacctaatcaccaccccaaggccccacttcctaacgccatcgacttgggggttaaaatttcaacatatgaatgtggggaccatatgaattttcagaccacattctgtttccttttgaaggaaacagaataaaccttgcaagaatgaatcctgggcccagatctttagagatgccctactatttgtggagggtcaggaaaccacgcccagaccattagatgcctcctcgtacgggtttgctggaacacataaaactgcatactaaaaagagtaaattttactgcatataaataatcctttactaaagaataaaacaatactttaaaaagttaaaaagaattagataaacacttggcaaaatttaaatgagttctatagattaaatagtattatatcaataattttctgatgtttattattgtactgtgttatataagagaatgtgcttgtttgtagcaaaaatactgatgtattaggagtaaatgggtaccaaatctgaattttactctcaagcgttgcagaaaaataatatgacacagacatatatatatatatgcaaagtgatatagcaaatgtggtaatattaacatttatagaatctgggtaaaggatatataaaaattctttgtattatctttgcaactttttttgcaagtctgaaattatttcaaaataaaagttaaacattaatacataaaatgaatgcatgaataaacgtaccaagtggttgcaaaaagatgtcagctatcactgctgcagcggctaaagcatatgagtatacaggtactttgcctactcaaagtttgggagcccaaaggctaaaagaaaatcaaaagacctaaaacaaagctgcaggtgtggatttctccctacgcagaaacagcttctgctgtttgaattcaggaggcttctactgttaccagaagcctctatacttccctaggatttgtattcataccaatttcagttcaatttttttaaattataatttctggggtacatgtgcagaacatggtttgttacataggtatgcatgtgtcacggtggttagctgaacccatcaacccatcatctacgttagacatttctcctaatgctatccctcccctagccccccaccccatgacaggccttggtgtgtgatgttcccctccctgtacccatgtgttctcatttttcaactcccagttatgagtgagaacatgcagtgttcagtttcctgttcttatgttagtttgctaagaatgatggtttccagcttcatccatgtctctgcaaaggacatgaactcatccttttttatggctgcatagtattccatggtgtatattgccacttttctttatccagtccatcattaacgggcatttgggttggttccatgcctttgctattgtgaacagcgccgcgataaacatgtgggtgcatgtgtctttatagaatgatttataatcccttgggtatatacccagtaatgggattgctgggtcaaatggtatttctggttctagatccttgaggaatcgccacactgtcttccacatggttgaactaatttacactcccaccaacactgtaaaagcattcctatttctccacatcctctccagcatctgtagttttctgactttttaatgatcgccattctaactggtgtgagatggtatctcattgtggttttgattggcatttctctaatgacagtgatgatgagctttttttcacgtttgctgactacatatatgtcttcttttgagaagtgtctgttcatatccttcacccactttttgatggggttgtttttttcttgtaaatttaagttctttgtagattctggatattagccctttgtcagatggatagatagcaaaaattttctcccattctgtaggttgcctgttcactctgatgatagtttcttttgctgtgcagaagctctttagtttattagatcccatttgtcaattttggctttggtcgccattgcttttggtattttagtcatgaagcctttgcccatgcctatgtcctgaatggtattgcctaggttttcttctagggtttttttttaaggttttaggtcttacttaagtctttaatccatcttgagttaatttttgtataaagtgtaaggaaggggtccagtttcattttctgcatatgactagccagttttcccaacaccatttattaaataggaaatcctttcctcattgcttgtttttgtcaggtttgtcaaagaccagatggttgtagatgtatagtgttatttctgaggcttctgttctgttccactggtcaacatatctgttttggtaccaataccatgctgtttgggttactgtagcctcattgtatagtttgaagtcaggtagcgtaatccctccagctttgtcctttttgcttaagattgtcttggttatgtgagctcttttttgattccataagatatttaaagtagatttttctaaatctgtgatggaagtcaatagtagcttgatagggattgcattgaatctataaattactttgggcagtatgaccattttcacaatattgattcttcctgtccatgagcatggagtgcttttccatttgtttgtgtcttctcttatttccttgagcagtggtttgtagttctccttgaagaggtcctttacatcccttgtaagttgtattcctaggtattttattctctttgtagcaattgtgaatgggagttcactcatgatttggctctgtttgtttgttattggtgtataagaatgcttgtgatttttgcacattgatttcgtatcctgagactttgctgaagttgcttatcagcttaaggagattttgggctgagacaatagtgttttctaaatatacaaccacgtcatctgtagggacaatttgatttcctctcttcctatttgaataccctttatttctttctcttgactgattgccttggccagaacttccaatactatgttgaataggaatggtgagagagggcatccctatcttgtgccaaatttcaacgggaatgcttccagtttttgcccattccacatgatactggctttgggtttgtcataaatagctcttattattttgagatatgatccatcaatacctagtttattgagagtttttagcatgaagggatgttgaattttgtcaaaggccttttctgcatctattgagacaatcatgtggtttttgtcattggttctgtttaggtggtggattatgttacttgatttgcgtatgttgaaccagccttgcatcccagggatgaagccaacttgatcgtggtggttaagctttttgatgtgctgctggattcagtttgccagtattttattgagaatttttgcattgatgttcatcaggaatattggcctgaaattttctctttttgttgggtctctgccaggttttcatatcaggataatgccggcctcataaaatgagttagggaggagtccctctttttctatggtttggaatagtttcagaagacatggtaccagctcctctttgtacctctgttagaattcggctgtgaatctgtctggtcttgggctttttttgcttggtaggctattaattactgcctcaatttcagaacttgttttggtctgttcgaggattcaacttcttcctggtttgggcttggaagtgtgtatgtgtccaggaacttatccatttcttctagattttctagtttatttgcatagaggtatttatagtattctctgatggtagttggtatttctgtgggatcagcagtgatatcccctttatcattttttattgcatctatttgattcttctctcttttattggtccagctagtggtctattgtgttgatcttttcaaccagctcctggattcactgattttttgaagagtctttttgtgtctttatctccttcagttctgctctgatcttagttatttcttgtcttcttctagcttttgaatttgtttggtcttgtttctctagttctttagttgcgatgttagggtgtcgattttaaatctttcccactttctcttgtgggcatttcgtgctataaatttccctctaaacactgctttagctgtggctcagagattctggtaccttgtatctttgttctccttggtttcaaagaacttatttatctctgccttaatttcgttatttacccagtagtcattcagcagcaggttgttcagtttccatgtagatgtgcggttttgagtgagtttcttaatcctgagttctaatttgatttcactgtggtctgagagattgtttgttatgatttccattcttttgcatttgctgaggagtgttttacttccaattatgtgctcaattttagaataagggtgatgtagtgctgagaagaatgcatattctgctgatttggggtggaaggttctgtagatgtctattaggtccagctggtccagagctgagttcatgtccaaaatatccttgttaattttctgtctcgttaatctgtgtaatattgacagtgctgtgtaaaagtctcccactattattgtgtgggaatctaagtctctttgtaggtctctaagaagttgctttataaatgtgggtgctcctgtattgggtgcctatatatttaggttagctcttcatgttgcattgatccctttaccattatgtaatgcccttctttgtcttttttgatctttgttgatttaaagtctgttttatcagagactaggattgcaacccctgctttttttttttttttttttgctttccatttgcttgataaatatccctccacctctttattttgagcctatgtgtgtccttgcacatgagatgggtctcctgaatacaacacactgatgggtcttgacttgttatttaatttgccagtctgtgtcttttaattggggcatttagcccgtttacagttaatattgttatgtatgaatttgatccggtcattatgatgttagctggttattttgctcattagttgatgcaatttcttcagtgtcaatggtctttagaatttggtatgtttctggcattggctggtgctggttgttcctttccatgtttagtgctcccttcaggagctcttgtaaggcaggcccagtggtgacaaaatctctcagcatttgtttgtctgtaaaggattttatttctccttcacttgtgaagcttagtttggctggatatgaaattctgggttgaaaattcttttaagaatgttgaatattggctcccactctcttctggcttgtagggtttctgcagagagatctgctgttagtctgatgtgcttccctttgtgggtaacctgacctttctctctggctgcccttaacattttttccttcatttcaaccttggtgaatctgactattatgtgccttggggttgctcttctcgaggagtatctttgtggtggtctctgtaatttctgaatttgaatgttgtcctgtcttgctaggttggggaagttctcctggataatatcctaaagagtattttccaacttggttccattctcaatgtcactttcaggtacaccaatcaaacgtaggtttggtcttttcacatagtcccatatttcttggaggctttgttggttccttttcattcttttttctctaatcttgtcttcatgctttatttcattaagttgatcttcaatctctgatatcctttcttccacttgattgatttggctattgatacttgtgtatgcttcacgaagttctcgtgctgtgtttttcagctccatcaggtcatttatgttcttctctaagctagttattctagttagcaattcctctaaccttttttcaaggttcttagcttccttgcattgggttacaacatgctcctttagctcagaggagtttggtattactcaccttctgaagcctacttctgtcaattcgttaaattcattctcgatcagttttgttcccttgctggcgaggagttgtgatcctttggaggagaagaggcgttctggctttttgtgcttgtttttcctcatcttcatggatttatctacctttgttctttgatgttggtgatcttcagatggggtttctgagtggatgtccttttgttgatgttgatgctattactttctgtttgttagttttccttctaacagtctggcccctctgctgcaggtctgctggagtttgctggacgtccactccagaccctgtttgcctgggcattaccagtggaggctgcagaacagcaaagactgccacctgttcaatcctctggaagcttcgtcccagacgggtacccaccagatgccagacagagctctcctgtatgagatgtctgctggtgggaggtgtctcccagtcaggagacacagggttcagggacccacttgaggaggcagtctgacccttagcagagcttgaacgctgggctgggagatgcactgctctcttcaaagccagcaggcagggatgtttaagtctgctgaagctgcacccacagtctccccttcccccaggtgctctgtccgagggagacgggggttttatctataagccccttgctgggctgctgccttttttcagatatgccctgaccagagaggacgaatctagagaggcagtcaggctacagcggcattgctgagctgtggaggattccacccaattgggacttccccgcaactttctttacattgtgaggggaaaagtggacctctttctccacaccaaatttgagcatcccaggtcaacttcagactgctgtgctggcagtgagaatttcaagccattggatcttagcttgctaggctccgcgggggtgggatccgctgaagtagaccacttggcaccctggctttagccccctttccaggggagtgaacagttctgtctcgctggcgttccatgtgccactggggtatgaaaaaaaaaaacactcctgcagctagctcggtgtctgcccaaacagcctcccagtattgtgcttgaaacccagggccctggtggcgtaggcacccaagggactctcccggtctgtgggctgtgcatactgtgggaaaagcatagtatctggaccagagtgcaccgttcctcatggcacagtccctcatggcttcccttggctaggggagggagttccctgaccccttgtgctttccaggtgaggcaatgccccaccctacttcaactcaccctctgtgtgctgcccccactgtctaaccagtcccagtgagatgagccaggtacctcagttggaaatgcagaaatcaccagccttctgcattgatctcactgggagctgcagaccagagctgttcctattcagccatcttgccagcctgcaatcctatataagctttctataaatttgattttatagtatgggaaactaataatattctgcactttgatattcttacttttcgtaaggtttatttaacttattcttaaattcatttgaagatgtgttgaaagctgtattttctgctgcagttgctgaggttggccatgacaataaggaaattcaggatgctatagctatggagggtcagttcaatcttttaaaccagcaggattgtccacttggacacagccagtttgtaggtctgatgctggttatctaccccgagactgtgaattctatctacacatggataatataaatgctaatggagaagtaggacaccagggctggacagcaagaaaaggaatcttttcccttcctgtttgagttcatgccttcccaaggttcctttgtcatctcataggtaataatagaggtaattatttataacacactacttatttctaagaagagataggtattttacatttacaaaactgtactaggaggttcactcttaaggagaaaaaggaatgagctgttcttggatttcggcacttgctcattgcctcagactgaaatgtggaagttgagagaaaaaaacagctatgggctgggcatggtggcttatgcctgtaatcccagcactttgggaggttgaggtgggagaatcacttgaggccaggagctcgagaccagcctggccaacatggcgaaaccctgtttctactaaaaataccaaaaattagccaggtgtggtggcatgctcctgtagtcccagctacttgggaggctgaggcaggagaatcacttgaactcaggagacagagttctgcagtgagccaagatcacatcactgcactccagcctgggcaacagagtgaggctccgtcttaaaaaaacacaaacaaaccagctgtggtacctgaatgggattttggcccaaacccaggcttaattcagtgaaaacatttcaccttttaatctttcatctttgtactcttttcattttactattaagttgctttcttccttatcattttccaacttttgcaaaacgaaaaatggctaactaaggccaataataatggccagcatttctagctcaaacagaagcttgggtttctcctccattaagatttgcagtcctgtgtgataaatcagagagacctggttacacattacaaacaaatgaaacttctggctaaccatcagttatagtcaattggaacatggttggttgagagcacttgctgtaaaagctctgagaagaggaagaattttactttagcacaaaattttctttgctgggatgcaatcatgcaaccatatcaaaagtttaaacccatccccactactttttcatggcccccaaaacatcccagaataaataattttaccattctttcctctacttctcttctagtttgcctgtcctcctttctaattacgttattgctaattaggaaccgggggaactgtacattttgaaagtggtgtgtgaaagccttctgctaggtcaaataaaacagccaggattaagatgttgacttagtgggttaataacagttaacaagacgcagtgacctacctgaatagtcaacaagtatttggcctggaatccacgaactacctttgttttgaaagggatcattttctgctttgtgagtacagctaattcacttgagaaggtaaaggtatttctcattagcctttctagtacataaaattatacatattgatagaaggaccttatccagagaccccctagagcaacccagtggtctgccatttgggtattgatctccttccccctgaagttctgatcctaattctcctactgtaaccagcaactgccatttattgtgtgcccatgtgcaaagaattgagctcatatactcatttaatttttgtgataaccctgggagcaagtatatacatgataaaaccaaggcttcactaatactttcactcaaatacaaagctggcagtccctccgaacaaaggctttgctggttttcattccctaatactatcttggtgtagagcagaagccaggcagtttccccttctctgacttgataatcagcagcttccagtgttttaaaatccttttcctttgtgcaattcaatccctctaacttaatgtcccatatagatatgttaacattctctaatggggactaagacggcctaatgcttgttcaataaagcaccctatttggttgggaacagaatcaatgagtaagttacttgttatcaggcaagccatttgttgaagtgtaggcctggctcatttggtacctggccagaatacaatcctgatgggcttaatggaacaaaaacatggcttcattatatttgattttcattcaaatggtgatctagttccattgtgtctggtgaaaggcagagaaatagttgaccttttatagatgcagggactgattttgagtctgttcctaaaaacagtttaaaacctgcaccatttgtacctcttcccctgtctccatggccctcaatgcagggcttttgttaataacctaagcactgtcagccatgtacagcaagggttttcagaacggctcccatggaaatgtccctgtgctggaccaagatgctgctgacattaatactgatggctatctgttttctattgctgttgtaatgaattgccatgaatttagtggtattctcttacagttctggaagtcagaagtctgaaatcaatttcactgggctacagtcaaggtgtcaacagggctggtttcctctagaggctgtaagaagagaatctatttccttaattttttcagctgctggtggccacctgtattcaacagttttcctccatcttcctgcactccagtctgtttccatcatcacgatgcatcttccatagtctcttctccttttgcctccctcttataaaggacattcgggccttatattcaaggcccacccagataatccaggataatctccccaactcaggattccttctgccatttaaggtaatatgtactaattccagggattcagatgtggacgtctttgagaaccattatttagcttaccacggtggcttttgctctatttatacaaaaagtaagataataattatattgtctgtaatttaccttaatacacttccatttagatcatatcatgaatatgtgtatgtgcaagttaacttaatttgcactctagggatgctaagttaacacttgaaatagcgtattcagtagtccacacttctcaggcgtgagcttcaactattgctatctggatttgctccatagggataagtaaaacaatttatctttgatgaaataaggaatgtttaagacatgtggtagctagaaatgttgtacaggtaccttaccccctacacaaattgggcataagagtgaggtccacccaccagccaaacagagcacctaattcttgagctccattcaaaacaagtgcctcctactctcatcgcataatgaagaatcccttcacctgacgtaactaaaaggttaattggtcctgtcatgagaatatttttgcatttgcctcagagtgttcatttcatgcaaaatgctttaaaatatattgaattggacctttgaccaatcttttagtaaaagtgtttatgcctgcttataataaatagctgaacacagggtagaattctgtgttcttataataaatagctgaacacagggtagaaatttgttttaattgaaacatgccatctgatagcaaagctgtctaggaggaagcagatactcctactgaattctattcttcagaggccattcttctgatagtcatcaaacagaatctaacaaataataaatatccaaattggcttagctcagctctcaatacttacagtcaaatgttctccatttggagattgtttcctgcaatcattttcttaaacttttagtccttgcttccattttttctgtttataacgactagcaaatgataaagtgattggacaagtagcaaatgaatatttgccaataatctcagcaacagtcaagccacttaactatgttgattgcttcatggatacatgctcacaattttgattttctatccaattcacagaatttagtcctgttttctgacaatgaaattgttcttagtttaagtcctagagttaaatacatggataggtcatagtgcaaagggtgccatggctttgaggggcttttccagttggactcagttgcatacattaacttgtcctgccctcctatctaaacagctatctgtaaaacctgccaaatttcatgaatgcctcacatggcatttgaatatattcacactacaagtgataaatacagagagacagggttgcctttatgacagttgactctgctagagacaaggatgtctcgaatgctgtctttgctggccatctgcacgatgcagtctccttgtcctcctgagtgtttagtggtttgtgtgtttagatgtcagtttgcctttaactactccgatgcctccgttggtgctccctgtatcctcgaggtaggtttctgccagggtcccttacttttaccttcatgttatccttagcaatcttgtccacttctaagaccttagtcatagaatctccaattctctagtccacagtctcagccctgtctcttagatccaggtgtaacttcatatctactttctacagttttccatatgctagccatttcagaaccaaatccatcaaaatacaccttagccacatctgcttttcactcttggctttcctttctccactcacccctcaggctcaggattctttttgtgttctgacctctgtgcttcctgaacaccctcatccagtctgtgggcaagtcccagcctcccaaacacatccaagaagtcttccctgatcctccctgacctcagccaagagtgacatcttccatatcaacccacaactttcttagagcgtgtgtctcataacaggcttggatgctcacatcctatctgtcctacttattataaactcccaaagtggaggcatttctccttattagcctttctaccttcagagtgcctatttcagggccctgcatattgttctgagctagaggtaatggatgtggaggttggccatctttttggtagaagatgcctagagatggtgcatcctaaattttgtcttgtttagcctgggttcctctcaggttgataggaagcaaatttcatgacaaatttttggagttcaatatggaaaagaaataataaaatagggatacatggaaaaatgcgatccaagaattcgttatgtgggtcaattgaaagaagtgtttacaaccagattctctgggcctggaatctggagctgagtctagggccactttattaaaaaattctgcggcactgtcatctgagacagttaaataaagcagataagggagtaaccgcaagttagaaaaatactacacttcatttaagcagcattctgctgactgcataggccacttcagcagagctgccagtatgcaatgccagccagaactgctgacctgtgtggccacagctgctacaatagcagcaggaatggggcctccaagcaaagcattcaatccctctgtatatttttctgaatgaaaggattccataaaaggttgtatgcttttcagattactcttctcttttccatttatcagttcattaacagacaagaatggacccagaagcagtgaaagggcaaagcccccttcatgctgatttaatacttgagtaggctaaacagtggcccctagatatccaggtccccatccctggaacctatgaaccctattatccatggaaaaagttaaggattgtggcatgggtgattatcctggattatccatgtgagccctaaatgtaaccacaagtattctaagagcaaggcagagggagatttgacagacaggagagaagaaggccaagcaatagaaaatagggtgaagcagagtcagacagaaaagatggaaacccttggctttgaagatggaagaaggagccacgagccaaggaatatgaggaatgtgtctatagaagctggaaaaaactaggaaatgtattctcccctagcagagtctgcatggccaggtgcccttcagaatgttgtagaacgcattctcatgtttggtgggaggggatctgaagaatccctttcttatttgaaaaatcaagcacatgcctagcaactccttcctctttggcattacagattttttgtctgctggattgtttccagcagcatacaacatataataatatctcccagcttaaaaaaaaaaaaccttccttaatcacacatattacttcctctataactccatttctgtacttctttttcacaagtgttgcctgtatactttgtcttcacttctttcttatcattttctctttttaaaatttcttattttaaaatcatttcaaacttacaggaaaaaattacaagaataatacaaatatttcccatattccctttaccctaattcatcaattaagactttccattttttttatttctccctccctctcccctcgtcccataggacgtgtgggtatttgggtgtgtgtgtgtgtgtgtgtgtgtgtgtgtgtgtgtgtgtgtgtgtgtgtacagctcttgtgaaagtcaccaatgacttccaggttgtcaaatctaatgatcatgtttcagttctcatctaatcagcagcaccaaaattagctctctgtgaaatatttcctcacgtggcttccaggacacctctttcttttcattctgtctaccccactggccactccatctcagccttctttgccaggtcctcttcatcatacaaacttccaaatgctggaggacccagggcccagtccttggatttcttctcttctatgtatactctcactctccacacgtcctcatccagtctcaagactttaaataccatctataaattgttaaataaaatttatatctcttgtcctgacctctcccctgaactccagatttctatccccaaatacctactcggcaggtccatttaaagatttagctgtacatgcccaagtctgaatttctgatttctcaacacctacctattatataaagtccattcttcctattatatagagtctcccatttcagaaaatggaaatttcacctttccagtcattcaggtcaaaaaccttagttatcctcgacttctttgtctatattataccccatattcagtccagaatgcaaccaccccttatcacttccaccatcaccaccctgcccacaccatctcctgcctgcactttggcaatacatttctatcttacttatttgtttttgtccccttatagcccatttgtcacatactgccacagaaccatccttttaaatcatgattaatatcaggtcactcctctgtgcaaaacccttcaagaacttcttatatcacaatgctcactgcattccaaattgtcactgacgttcctcaaatatggcaggcatggattcttattccaatccctaattgagaacccccaaaatttattctatccattgcctgagcttctactccacttctaaacatgcaggattcaatgttaagagccaggaatgcagagtacagaaggacaaataacaatgctcataagggaggctttttgaaaaaataagcaaaagcgtgtagtgacgggattctcccaatgggtgaggagttgccctaagtcttcctttaattcatactttaaaatctaccatcaatacagctggctactctgggaaactgttttgcacattgactgagattactaagattagttccagctcacaatttcatcatttgaacatcaaggttaaacatcagaacatttcgcttcttcccgtcaaggcttgttgcaatgtcattatcttatgcaataagaagagataaattataaatacctatattctatggctcagaaggagtggattcattttagtgtgtggtatatggattcaatcttactagttcccaatcccacctcatatattactctttgttcaatacttttatctcaaatacaattcattgttcaattagcaaatgagagactgcatgtagtaattgtatcatatttaaagaaaattgctttgtacaggtatttagagaatcaaactagggagatacagttctcactatgagatgagatgaaaacgttgacaccagttctatcaggcactaaataaatatcaaggcaaaacactaaacaagaccaacttatcttttataaagtaaagggacaacagactcaatccataggtccttattttctcccccactgtatgttttgatattttcttgccaaatggatttaagggaatgtggatggagacttcatagaatctaatctccatgcgtaggggctttagctgtgatagtcccttctatcttcagcacttaccacagtacccagcacatagatgctcattaatatttgttgaataaatgctctggaagatgggcaagattataaatactgaggaagactacagacaggactcatgttttttccttggatagctactgtgtatccaggtgtatgttaggtgctcagtatacacaataaacaagacatctactatctcacagtctggtggttagataagaaatgatcactcatggtgtgagaagtgctatgatgtggactagtcagtgtaccatgggagcacaggcttcaagagacagggaaggcttctggaggacagactatctaatatgagccctgatatgtaagtcaacctgttgaagttggggtgaaagggatctttccaagaagagggaacagcacgtgaacaagcacctggcccaggaaacacagctttcacggggaagtgaaagactttcagtacaatcagatcaaagccgaggggaggagaagacttgaggatgggtacctagatcatatgtgtatactagtttttgaagctgatctctttgggtatatgtcataaacttaaagaggcttctcaacgcctcttttgacttgttttcttgataaatacagaaaatctttttaaattataagatggattttttattttatactcacactcacattttactgtggatgaaggtttagtttattaaaaagtacattccagaatgtttgttaatggccaataacagacagacacttccttactggacattggtaaggaagtcagtaaggatgagtgctacttttcttaaatgtatgtactaaacctggtaatgtgacttataatgtctcagcacgtaatatttatagactaaggtgatagaaaggatggattccaccattgttcttgctaaatgcataatgaaaatattcatctagggacaggattgctacatatgctacagtccagatataaaatacagttttgtatggttcaatagcttataatttagtgggtagatttgcaattagatttatatacctggcatcaattttgtcataataaaatgttttccattccaggtctcagcttttagacacaagccactagataaaaaccttttcctaagaagttaaatgtatgtgaactagacttttgaatgccatttgtaattgcctggttgcctgcaatagctttcttggtgcaatcctggccctgttgcagtgtattctcagcccaagagtcacagtcatttttttttaattgcacatcaatcttttattagaccgatcaggaaaaaggatttagtaaacttacgctcaaatgaacactgggcccatgtggcagggccaagcaaatagaacatggttcagaaatcagtcagtgaaagacacaaaacaaggtgggggagggattctaaaacacacagcaggagacactcctacccctcagaggtcaaggagcttatatgtggtctgacttactctttgaaagagtgactgcccccaggagacagttactctttcaaagagtaagtcagaccatatcatgctgttggtcgaatcccagcaaatggctccccatttcactctgagggaaagccaaggacctaagaaggcctatgtggctataggcccaccccaaattcactgctgttacctccctgacctcatctgcatccacactagtctcttttctcttctttgaacatgccagccaccctcctgcctctataggacctttgcacaagctcttccctcttcctgaaatgttcttccctaagaaatccacaaggctgtctccctcacctcctccggtctctgctcagatattatctactcataaggccatccactaaaattacatcacacacttctaaccccctaccgtgctctccttgatttgccatagcagttttcaccttctaacatactatataatgtttgtatttattatatttattgctaatagaagcaatatccacaaagtctcatttttgtctcttttgcttatgatacatcccaagcacctagaagacagactggcatacttacatatgttcagtgaacattcatttactattttattttaatttttttgacacagagtctcactctgttgcccaggcatgagtgcagtggcatgatcacgactcactgcagcctcaacctcctgggctcaaacaatcctctggcctcagcctcctgagtagctgggactacatgcatgtgctaccatgcccagctaatttcaataatcatttattgaataaatttctgaaataaaactttgtacaactagcaaggattgactagtggagccagtatccttcactttaagcagaaagaagatctgattttaaaacttgtatatgaactaatttcctttatatgtaaaacaaaagcagattctattttgaaggacatattagcattattcatctcacaaccctggcaaagagtgtgtgtacaccgttatttaagtatatacatagcaggaaaatatagcaaatatgattgttcacaaaatcaccacagtatggtaatttaagatagattgacgtctgtggaagatttatttctttctaaaactggcataataatcacaatgggaactattaatacatcaaatttcatttttcaaaaccaacagaagccagttggggaacttttggaagactagtattctaatggattaaaaatctattttctgctttgaaatttaagaggtaccatttaaaggcataattgcatatgccttttataaagtcttataaaagctcactgtctttatgccaacaaagaggaattgtaatgaatgtgttaggactactctctaaatgtcatctcctcaaatatgaattcacaggaaaagctgtccatttccaagacaagcttccttgtagaaaccacaactagaaagcatcaagtgtctcatttatttctaatttaattattaatctaagagggccatggaaactgtaacaatattgcataatgattggctgatctagtgacaggcaatgatggagtaaggctcctccaccttagctctttaatatattaatatgagtctttaaaagtaggacctagatcagatcaatcaagaatttactaaatatataccctatcatggggcaaaaccaaagcatataaaagaaccaacagacacaatacccttagctttattcatgtcaaacaagtacattcacttttattgcattcattgtgatcctgctgctttatagtgataatttgatcacaaaggtatcaatttaaaaaaatcaaatccagctgtaccaagtaagtgcctacctgctaggccaaccatgtataccaacctgtgagtgaacactactgaacttccactactgaacactaggatttagaaaagaatcacttcacaagtttagggttctctttaataatggaatccaataattgtttgttgaattaaagtatatatgaatgaatcattttgtgggtctaacagtattactgcaggtggagcttggtcatcacccaccaagtagcctccatacattcattcaagtgttccttactttgcttattcattcaacaaatatttattaagtgcctactatttgccagatactctgctaggtgctgggaaggagagggggataaaagaaacacagcctctgtgctcacagaatttctttttactttgagaaggcagataatcaacaaagaaagaaatattttcagataatgatagtgctatgaaaacaataaaacaggataacatgataaaatgatggagaatggggtaggggcaggatagtgtggtcaagggtggtctctctaaggacataatatcggagctaatactgtcataaagagaaggaaccagccatgtcaaatgccaagatagaagaaacaataatgcaaaggctcaaaggagtgaatattgtttttgaggaacaggatgaaagccaatgtgctctgattgtattgagtgagataaagtgagatgcaagataaagtcaacaaggtggacagcatccagattacaacataccagattagtggttttctttctttttttttaatctttaaaaaatattataggaataccttagaagctttttaagcaaggaagtgatatggactgaattctttttctaaaataatattctacctatacagaatgactatgtgggttttaaaaaatcaaatagaacttctggaaatgaaaaatgtaactgaaactaaaaactcaatggactggttaaatgacagatttgatacagctgaagaaagatttaatgaactggaaaatagaatagaaaaataacggccataatgtaactcagaatgattagattgaaaaaatatatataaaaaagatatgtatagattgtagagaggaaagaactaaaacgtttaactaattgaagtttcagaaagatggttagtggggcagagggggaagaagactaggtcagaagcaatctttgaaaatataacacagagaattttccagaaatcataaaatatactagtccacagaatcaggaattctaatgaatcttaaacaagataaataaaaagcaatctacatctaaacacataatagtaagaatgcaaaacactaaataaaaagagaaagtatcaaaagccaccaaagaaaggataaattactgtgaaaggaatagactgacagataacttctcgagagcgataatggagactaaatgacagaggaaaatctttcatgccctcagaggaaaaactgtacttgaaattctattcttaggaaaatatcttttaagaagatattaaggaggaaaaaaagatactttcaggcaaagtaaaatggaaaaaaattgctctagtagacttttaccaaaaaaaattctaaagaatacaatgcaggcagagagtggtttcaatctgggatgcaagacggattaaagagaaagagaatagtaaatacatgaataaatctaaataaacagtgactatatccaaaaataatattttgggggcttaaaaactgattaaaatgtaaaacaacaatatcagggtaaagtaaacagaatttaagtgttagaggattaaaaatagaacaccagtaaaatttaaccaaaggacagtaactacattaatttcagataataaaagactttaaggccaaaagcattactaaacacagggtcctaacgaagtcatcacaaccaatatcctattctcttttcttctatttctttttccattttcttcttaattccatttctgtgtctctctgcctccatttctcttcattttaatactgtttgttcttctcatttggctttcttagagcagggtaggcactagttcctacattacagccgtgctcatgattcccgctctgacaatgtgaaagttgttctgaagaactgccgctgaagaatttttgcaagatcaaagacaaattgctctggggctaaatatctttatggactgccaatttgagccacaaatactcaaaccttcattatctttcctttgttagagattctgtaagtaaccctgagcaggtaatttacttcatttcccctcacttcttataattaaaacaaaaagacttatctgcaactaggtaaggaaaggtgctgatgataaaaaaccaacaattgtaaagttcttaaggtgtttgtaagagcaataaaaacctgtttagattacatactatgcactaatttgtcacagaggattgcagtacaaaaatacatgtccttcaaccagtcaaacaggaaagaacttggtaagtctttgaatgtatgagaagtgattattacagccccacccaagtgcagctacacatgccagcccagatcctgctgttgtttttccttgtaaagctagcattgatttcaaaaggtcactaaatgcaactcctggattctgaagaactgtacttagggaaaaagaattgctctttatgtaatacttctatcttataaaaaaaatagattatcaggaaaaaaagacctcactttatatacctcacatctccatgtgtcaactttaaatttcaagatgcaaattaaaattttgagtgacactttgtttttaagaactcaaattgattagttttctctctctaacatttattctgatttgattactccctaacgcatgattacttcaagtaggtcgtgtgaagagcagctctgagtgatttgggagatgttgtttaacatctctgtgccttacttttctatagcctacctcacaggatggtgaggcttgaataaaataatacatcatatttagagagtataatatttccctacctctcatcaggagcccaaagctctaagtactaaaaatacctcttaccttgctaaaaggagatggagaaaaatttatactagtaacttacttctgaccaaccactgatgggtaggaaaaggataaaatgccttttataaattttcaacaatgaaattcatgcgctataaaggtggtaggagcagctaagagtaacttattcatgtctttcacttgacttggttttatatggacagaatctgttacaagaatgaaaaaataaatatatgatgtctacatctttatatattagacagatatgagtaggtgggtaggaggaagggagagagaaagaaagaaatgaaggaaaaggagagaaaaaaaaccaatttaaaccagcagcatgtgtaccataattataaattatggactactatagcatgatgagtagttttagtatatgacagttcaaatgaaatctttcacatgattttctaacttttggtgatattttcaaatctcctttttaaatattcagaatcagcacatggtactgaacaatgtcttatctttattaccaagtcagcagccatttttatttttcttttggaatttggaaactatagtaaaccttgaggtagggcaccctatttaattcaaaaacgtgatttcaaaatttgcttttcctttttgtttcatggcagtgtagggagtgtggtatttcagcaaatctgtgactgtcactgtcatcacacagggccttgttcatagcaaataggcaagaaatataagccggtaataatgatgattcaagccccactcaattgagagcctaaagttttcattccaaatctgatttggagaattggctattaaaaaggaaaatttaataaggagattgaaagaggaaaacagcctactatatcctcagattctgatttaggaattattttttaaaaattatcctttttcttaactggcttgaaggaatgaaagcaacttggtccaggaggaaaatgaaagcgtgaactagtaagtgaaaaacacaaatggccacagatccagcctcagttaataaatgcaaatgtgccctgatgtgtactaccctacagagaatactgtggacttttgattttggtttataacccaggtaattgtttacaatttggttttaaaaataataaaggtatagagacgctttcaatgtctataaccaggtttgtagattttgatcaccaagataattttaagccacaccctcgaccccctgccacaattgacttggcaggtataatcctaaaacaccaaactattcaaaacttgaggcctctcatgtggtctcgactcctcctttttatgaagtggagtcatcgtgtgaatttcaaaattacaataagagataagtcacagaggttaattcaaagagagtttctggtgcactcaaacacatcgtctatgctatgccgttaagtggataacttattgtttctattactttctgaggtgtgttcaacttgaatgcagtgattttactactaccaagattggttttgtcttccttttttttttttaaatgctgttgtttatttgcagtcaagaaggagaaaaaaacctttaagttcaaatgccaaagtcataatattaaaatatatgtgtgttgctctcttcataattaacaccattgtacagcatggttatgagtttagaagatgaaggaaaaattcctcatgtcaatactttttaacccttctgcaggtacttacaacttagtgtacttcaaacccatctctgacttttttaataaatgagattcctttttcccccttaagttagttaaatttcaacgaataaatcgtttctatttggccttcaagcatggcaattttctgtgctgtaaaaggttcattctaaccacaaatctagtcaagtggattctggaaacactttcaaagcaatcaggtcacaggtaggagccaggcagaaggttggcaggctccatgtgagatttccactacagaatcctgacattctttcaaacattatcttttcttgtaaagggaagccagaggtagcaaagacacctgattctattaaaagagcccttggagtttacagaaacacagttactgtggcacaactgagacaaaccaaaagaaatcttcctaagaaatgacattaatcttaagcacagagtcaagaatcttataacgttccacattatgccccaaattcctgaatcagagagctttggaggaagaagcaattttctggctgtgcccatttatgctacactctgcaaggtgagctgacccacccatcttcacacccctgtttggtctcaaatgctgctggcatcccaagcaatcacccaggactccaaaccttcccttattctccttcaggagcctaactgctactcctctttttctcctgaaatcaggctctttgtgccagctttgtccccctcccctgatcctttcctgctcatctctccccagcctttgaatcatggtgctcctactaaattccaggtgtccctcattctctggccctggctttgctatggacatgaatgaactttcctggtcctaccaaaaaccccaagccccctccagctctttggcgagttctcagcctgtctactgacaatttctaagtcatccatgagtaatactgatgctgtttgaaataagaaagaagattatcaatgctctaagcttctctttttaggataggataaaataaatgacgggctaaacccagtccttataagcccaggtgtctgtgcccacagtatcaggagaatgacggggcattctggaagttgccatggagaccaccatactttctgttctcttctggaggcaccaatatacttcagagcaaaaaataacttaaaatttccatccttcctagaaacaggctaaattatgaatggcaatgattgttgactcttcaccaaacctctggttccttttcctcctgggcacacagcatgactacctttccaagccactttgcaattaagtacagccatgcaactagttctcaccaataaaatgtgagcagaggggatacatgtcaagtcctggccacgagtttatgaagcaggtataccccttctacatgctccctttttgcctgctgggtgtaagtgataaagaggcccagccaacagaagaaccataaatggaagacaaggttttctaaaattctgtgtggaagaaaatcacccaccaaccaggaacacacacattggacggttatgtgagcaaaaccctctactatgtttgaaccattatacatttgggtgtctgtttggtattggagcaatgtctacactaactaatgtaaccaatatattatgcttaagagcattaaatcacttgagtattagaattctaggccttgttcctggaaaatacaagagggactagcgaaagggaagggaagcaggtggaaataataatgtgaatagctgcaaacattttccatatatataaccatgtattacatgcattacacatactatctaatttcaatcattcctcacaacaactttaggaaacagtactgtattatcccattactcagatatggaaactgagggagagatgaaatactcaggaagtggagaagccatgattcaaatctgttgactccatagcccacactctggtggaatatcaactctgtgtcctagacattttatacaattttttctttttaacactgtgtaaaataagccttattagccccattttaaagattagtaagctgagattcaacaaagataaatgatttgtctaaggttacaactagaaaaaatcgaaacccagattcaggccaagatctgactggctctaaagccactgagaaatgagtccctcattctctttcccttacaccacagaggtcagaatacagatggggggagatatcatgcagaatgtatttcactctatttatgggcttcagatgtctcagaggttgatctgttaggcctgtgactgtgtgaccactgcagtcattactatttgccagttttggggaccccagggtttctgttggatagaggtcaccaaattacccagcctgtcattgaggctattttttaaaactgataacaaacttgttaggcatggaatagtcagtccctcctttgctatagccccataagaggaattctcagccaggaagttgccatgtagaccaccatactttctgttctcttctggaggcaccaatatacttcagagcaacaaatgacttaaaatttccatcctccctagaaacaggctaaattatgaatggcaatgattgttgactcttcaccaaacttctggttccttttcttcctgggcacacagcatgagtacctttccaagccactttgcaattaagtacagccgcgcaactagttctcaccaataaaacctgagcagaggggatatgtgtcaagtcctggccaagagtttatgaagcaggtataccccttctacatactccctttttgcctgctgggtttaagtggtaaagaggcccagccaacagaagaaccataaatggaagacaaggttttttaaaattctgtgtggaagaaaatcacccaccaaccaggaacacacacattgtactgttatgtgagcaaaaccctctactatgtttgaaccattatacatttggttcaaatgggtgggtgggtcagtcatattcaagcctacaggaagagcaaaaggcagtggcatagaagctaattctctcaatgaataaagcatttatgcataggaagagttatagtagagccagtccacaaatctacctcacaaagtctttaaagtcaaggagggctaccaggaattgtgtttatataaggacttctgggtcctctgaaaataagtactaagggaatgtcagggctgatcaggacactggaacggacttaaacaaggatggagatggggaaactggcataactcccaattagaaatgaagaatggggagaagccatccacatctgtctccgtgctttttaacctgggtggtgcaccctctgatcacatccctcctggcctcacaatggctacttggcatataaaggaattcctccaggtccagacccattccttctcccttctgacttaatctgtgggacttctgatatatctggagtctatatctgggttactgctggaggcttacagtgggacaagatggcagcatcatataacttcctggcctgtgacatgaacctgaaagtccaaggccattttaggatcaaacagccacagtcccatattcattgatccaaacaacagacatctgtggttgggaaaaagcccaaggccctgaaggagctggagttccacttcagggcagagccagttgggccagcagaggaatggcaggaggctgccatggtactaaataaagaggggcgagcccatcgtgctctcagggttttccaggaccagagctaccacagcagcagccctgggtggtcccagagccccaggaaaggccggggaaagaagttcccagaagatcatactcttccacatagagaatcaagagaataggaaggggcatggaaagagaagcccttctactcccacattccttccagtcatgtccattcattctacaaatggtagccagagtgagtctcttccaaactgatcagatcattcttctctgacttccagttgctcctaggattaaggccaaactcattacttggcctataggacctcacaagggccctgcctactgctgtaatctaaattcactccattgtgccatcctctatactctccagaactcaaagtttaattattttatagcctgtaaattccatgaggactaagttcacatatttttactcactactttatactagcacttggcttatttgcctgacataggtgatgctcaatccgtattggttggtcagctgaatgaatgaatgactggctgaagagccaatattctagcaactaagttaggttgaagcaaatcacttgtgattgcagctacaacccttatttctcccataagtggaaggggatagagagacagagtacagttcaggcttctgtgttaaaggttaacagcaacaaagctttccgtcaaaggctactaagcacacacacctgcaagcagatttcactgattcaaatgctctttggaaaggggtaggaaataagtcaacaaatgaatgtaagaaatgaaattttactgttcctatatccttgaaatgactcagaagaatgccaccaatttggtttttcagttccctcccttttgcagtgatggtatttcgtcggtgcaaaagtaattgcggtttttgccacagtcaggaaaatgagatggaagtcctgagggacgaacctctgccctgctaccaactggatgccaggcaatccaatatgtctaaagaggtttttctggttgttttgtttgttttttgagacagagtctaactctgttgcccaggcaggagtgcagtggtgcgatcttggctcactgcaacctccgcctccaggattcaagcgattctcctgcctcagcctcctgagtagctgagattacaggtacgcaccaccatgcctggctaatttttgtatttttagtagagatggggtttcaccatattggtgaggctggtctcaaactcctgacctcatgatccacccacctcggcctcccaaagtgctgggtagttttctttttttgggaagacaaggtctcactctgtcatccaggctggagtacagtggcactatctcagcttactgcagcctctgcctcctgggttcaagcgattctcatgcctcagcctcctgagtagttgggactacagacatgcaccaccacaccaagctaagttttgtatttttagtagacacggggtttcaccatgttgcccaggctggtcttgaactcctgacctcaagtgatctgcctgccttggcctcccacagtgctgagattacaggcatgagccactgcacccggcctagagaagttttatgagtgagccttagtcagggctcactgctaagcagcatcaggctacagccctaagtgaaggaaaagcttatctcatttctgataagatgggatacgtggcagttttgattttggtgctttcctgtgatgggaggcttcaggacctggtttcacccaggatggagtttagacacagcataaccctgagggcataaggagaggcaggaagccagataagttatagtcggtaaggattaattaaacacaacccaggtgagaatgaggaagtagttcccagataacaaagtggagaaaaccggccccaggcctaaagacgtggcagcaataacctaacagcatgtgtgaactgagctcatgttggtgacaggacctgtggtttggcataggtttattccctaagcaaactcatgcaaaactgggtatacagcactaccaccttctaaccacagaatttaaagattaagtatgagattggtgttgtttatgagaaagcagagtgttgctgtattttctttccagggcttgtacaatatgggcaacatgcctatttggcctttgcttagatactcagcccgagagatgaacaacagttatttagaagacctgctgtagaagctctagacattgtgtgataaaactggagatttaacacacattctatgagttctgctcttgactaagcttactctctctacacagaagtaggcagtttaatttcaacacaggattttcacattatcttaagctcctactgtctcctactgactaagaagttctgctatttgaaaaggagtttattttgaatgttcccacagttttagaatcaatctcaatcatccagaggtgaataactcagtttcaaagcttaagcatggtaaaaatatatatatatataaatgtatgtaaaataaaaaaccagcttatgacgggggcagcagtggaatcggaaaaaaagagagtgaaccgataagaacaacatcatcaacatattagaagcagaagagggaattttttagaattacatagtaatgtttagatgccaaatttgtctactgagacatgagagaccctgagagtcccagcatgctggacaagcttgttgctgctgacgcagaagcaaagtgacatgcagatggctatgaattccagtaacacagactcagggcctagaatagaggttctcaccttggctgctcaggagaatcccttggagagctttgaaaaccacagcactcacactctactcccagagattcggatttcgttcctctgggaaagggcattagtactatccaaaagctccctaggtgattccactgtgagctaagattgggaagccctgggctaccatggaggatacaggtgaggaaggtaagggaaggagggagggggagggaaggagggaggggggagggagggagggaggggggggggagagagagagagagagagagcaactgagtataaattctccattcaattcacaaagaggggaaagcaacaaaccatagaacagttcacttttgcaccaagcaatttatataatgtttagcatttgctgaagtattgtactcataccatttttacacttccagatgatgtctctaaacactggatgccatttaactgcgaggctcacaataaatctatttcataatagccatttttgcgttatctacaacctcttctcccaatcactctggtgaaatcagaggtgactccagcacaaccctattcacttactttaattccctgtgatccatagccaggggggccaggagggccaggcaagcctttctgcccagtatcaccctgttagaagatggggagaatttgaagacaaaatgtaagaagatcgaagaagaaacaacgttaagtattactactctcagctgcattcttacttcagtctgaccaggactttcatgctgcctataagctacttcctattttacttagagtgcttccccaatatttttaaaccacagaattctatgcaaacaaaaccttaaatataatccaaataaaaattaagcagtaagcagagccgctgggcctaagcagaaatggaggcccagggcctcatctgcttgggcccccttcactgccctaccaccaagctcaagaacaccagggctgccctgcaccacatatgaaaaccactgacatgtggctccacatagccttaagatgttgctccatttcaatataaggtgtgatttcactggggttgcacttaaagatccagtggatatcaatgtccaaatttttaggaaaatgtgtagatgaagctataagcaagtgtagcatttcccagtatctgttcataaactgagcccatgtttctttggaaacacttcgtggtggaataagattggaaaatagcatgcgctttcccttggagatctccagtgcacactaatatagtagactaatggctctaacaagtcccacagtaaagaaattagtgtaacgttgcttatcccagaagttcctaaattaacactggatggaagaagccttcagaagtgctgggttaatataagttattgtataagtcagtcttttactttccagtattaaaaaagcttgactttttctgattataagaggaatacctgcccattgcaaaaaaaaaaattaaacagaaataaagatgacatgaacaagaaaaatagacccatcttcccatcacccagtgataatgactactaacatcttggggggatcttcatccatttaaagtgatctagaaggttcaaaaatagcataccgccaaaattgagttgagggacaaaacagagataaactgagaatcttggtaattctgggatgctcagtaaaatctttgactcatacagccttttccctctcctctctgagaatgggctctaattcacttctgtgcattttcggcatgaatataccaattcaaaatttgaatttgtggtgggtggttcattgacatctattttccctattgaacatgcttgctacttctttaccctactttcgaacaaatcaaagaaagttgttgagcaactgaatgaacaattaaaactaggtttctcaaactcagcactattaacattttgagctgagtcactctttctgatgggaggctgtcctgggcattgtagaatggttggcagcatctctggacttgatctactacaaccaaaaaatgtccctagacattgccacatgttctctgaagccagggaagggaaacaaagtctccctctttgagaaacactggattaaaagaataaaaggatgaataaccaccaaactgaaggagacatagaaaggagggaaactgggccaaaagaagttgctctcatcttctccagggacaatcagtctagacccttgtactgacaccctgccagagtagctgtggcacaaagggcacaatgacacattagcaggtgacctgttaaaaaagccacctgaggcacctctgccaaagtaaagatgtgcttcttgatgacggcacagcctctaagaaacccagaaatgttctgagcactttgcagttaaaaagaggctgacttgctcatttcttttgggggaagtgaatggctttataaactcgaatgttctattttactgaacgttcacctgatatgaaaaataagacgtttcatcagtcaccaagaaaaaaataagtcaacaccaagacgaacacttattatgaagttactgttcacttgtttgtcactgatgatatctgaccctcacacaaagcactgagctgaggactcacctttggcccttgggttcctacgccccgaggcccagaaggacctggagggcctctgaccccaggctctccctgaaaagacacaacaaataacaagttactaattttttaaagactttatgtttttttcaatatatatattttaatatcaaaaacttcttgaatgtgactaaggtattaattgaaccctcttctcctagatcacttttctattaccacctaggcaatcttcaaaccaacagatccaggtccatttcaaattaatcaagtcaattaacttcttggcaacattaacttttttcagaaccctcttctctagaatttggaaaagtaattacgagtattgtgaatagaggatggaagaagagacaagaataaaaaacaaccattaagaaatataatcatatcctgaactagttgcttttatcattgtatgcaacaaagattatgctatttgagttatgatgtttctgccacctcattaactggaactgcagggtaaactctaaaaaggattttcagcttcactaaggcatgacagcttcatagctggcaactattaccagaaaattggtggtacctgatgagggtaggtgacgccctgtggcaagacctactagagatgctaatgatgggaagaaggagagaaataaaaattgcttcattagccaccttctgtattcccaagactatgccatgtatgttcatatatgttatttgatataatttagtactcacaataatcttgcattataatgatgtctagtttatgtaacttctctgaacctcggtaaattcatcacatatgtagaaaataatatctacatttcaaagggctcagaattaagtgagacaaagcttgtaagtgtttctatcatgatttttaccacagaataggcacttggtatatgtcagctccactcacctattttattaaagtggaagctaaggtttgcccaagtctgcacagctattaaggtgcagggctagaaggatgtagaaaaacaggaaccctcataattgctggtgcagccactttggaaaacagtttggtggtttaaggttcaacataaatttgccaaatgatacagtcatttcactcctacatatacacccaaagaaaataaaaatgtatgtccacttagagacttgcatatgaatgcccttagcagcattatacataatcatccaaaactagaaacagcctaaatgcccatcaactggtgaatggacaaagtgctgtaaattcagcaataaaaaggaataaactatgaataaatgccataacatgaatgaacctcaaaaacattattactgatgaaagaagccagatatatgattacatttataaataatacccagaaaaggtaactctatagaaacaaaaagtagattagtcactgccaggggccagggacagcaacatggattaactataaatggtcgtgagggattttactggggggataaaaatgacctaaaactgatttatggtgatggctgtatagcttagtagcaaatttacttaaagaaccattgaattttatacttaaaaaggatgaattctagaatgtgtaaaatatgcctgaataaagtaataaagaaaaaaaagaaccagggtcaggctttgaactaccacccaagacctttagccttaggtcctgttttgcccatatcctgttaccagctaaacagcttccagcttccaacactgcaaaaaccataaattacaagaaatgttgaagttgttcattcagaaaaacagtccatcttttaatttactttctacttataaactctaaaatacttccagataacccaagcccttaaaaggacgggggccactttaaaactgtactttattactgacttaattcttttaatatctactttcataattatgtatttctattttgcttacagaccacttttattatactgtctccatctgttccacttagtacttagctgcttctaaggctacgggtgctaattatctctttaacacctctctcctactgactcccatctttgagggtccccaagttcctgccagctgaaaggatcactccaacatcaagggctccaagtagagaacatgaaaaccctgtagtacatacatttccattagcactcctttcttgagtacctatgaagtactttcaaagggagagtgtgtaagttcactgcctgaagttctccaactacacctgactgattcatacactttgctacatcttaaaaggacatgtcttttctcttccaaacattttgacactctccaacaaaacaagtcaagcatagttaagtaaatcttacccaaaatcatcgaaagtttcatcaaaaataatactcctctttgctcagtcaccccaacccaccccagatttggtggcttcctctcattcatttccgttcacctgtgcccttccaagatgaggtgaaaaggttaggaaggatatggccaggttgggcgcagtggcttacacctgtaatcccaccactctggcaggccgaggtgggtggatcacatggtcaggagtttgagatcagcctggccaatgtaatgaaacagtgtctctactaaaaatacaaaaattagctaggcgtggcggcaggcacctgtactcccagctactggggaggctgaggcgggagaatcacttgaacccgggaggcagaggttgcagtgaaccaaaaccacgccattgcacgccagcctgggtgacagagtgagactctgtctccaaaaaagaaaaaaaaaaaggaaggatatagccagacaccatgtgcctcctgctgtgatacattagagaatacaccaccctacctatcaatattctggcctagaaaaaactgaacctggatgtaaacacgtctcttgacctaccagctttgagtgtccccaagttcctgccggctattactaccagcttacagtaatagacggaagagggagaaacacgttacacaacaccatgaggatatcatcagcaaatccgcaagtacaaataacacatacactaactgcgagctaaaaacaagggaggagtctactttgattaagagagatttaagagctatttcaatcaaatgcaatgtgtgggcatgatttggatcccaatccaaacaaaccaattgcagcaaatgggtaagacaagcttggaaatgtgaatgctggatatttgctatattaaggaattgttcatttgttttaggtttgataatagtattgtagtcaagtttttaaaaagagttcttacatttgaatgacaaatgctaaagctttatatggatgatgtctgaggattgcttcaggataatgtggtgaggggaggagtgaagaatatagctaaaacaagatcaactatgtgttgataattgttaaggaagtgtgatatgtaaatgagagttcatttcactagtctttccacttttgtgcatgcttaattttcataattgttttaatacaatttttaaaaatccataaacaatatccagcaaaagtctctccagtgaacctgagatagtgttgctgtaatagacccccttaataataattcatgattttaaagatattaaaactgggcaaaggggaggagcacacaggtagattcaacatcattagaatttacatctgtcgtgtgtattcttgggatgtaccaaatgttacataattttttttttaacatagggatacggagagaaggcaagatttttttttaacaaagtagtatgttttaagaaaaaatttgacactgtagtatttaattcatgattttttttgtgtgagaatgttagctaaaacctcccctcaactagtattaattacactaatacccacacatgggaaagcaagcgggaaaagcagttaaaataggtccatagtttacctcaggccagccttgtcaatgctcagtgttgctattcattctctccttcacagtctcccttattcacgtccccctaaccctcaacctttgggagtatctgaaggccaactgcagtaggacagctgaccctgtagataccttactgttctctctgtcccgcagcctcagccaatgaatttaagatgtgttccatgtcatctgtggtccttcagtgttcacctaaaacaaactgtccatccttatccatataattgttgacatatagctatgtttcacatatctaaataatcttttgtatctttcaaactacgggaaaataatgacttatagcaatgcttttgtgaatctaatagactttaaatcaagtcttaacgttctgcagatattagaattggtctgtaacacggcatgagagttgttcctcagtgtatatgtaccatactttgatagatgggaacattaggcatttaatgatctgagaatccacagaagtagtgtctctccactatggtggggtctttgaaaatgatcttttgtggttccatgggccgtgtgtccatgttaggccaccacacctggtaaatgtgagcaagagaattgcggacaggtcttgcttggccatttgacggcactggttttgtcataaggcagcaccgtaggtacctaagaagtgcgttgacctgtgatattttcagatacacagtttattgtcagtggatacagcaatattcacaaataaaggaattacaacaggttgtcgcatagctggacatagcttcccacgcaacagctgagggttgttggagcctgcagagggagcccttgtattaggagataatgaacagacgtgcgagcaaattctagagtcgccattggtaacaacatctatcactttcctaagatgacagtcttagccttacccctaacccctgcacccactctctcaaaagaagaataacggactgtttagatggcataccacttcctcttggcccgccaaagggattctagatgggagatactactttcattttcacaggaaacggccaaattcaggactgtctgcagtatttgtgcatatgaacttaacaaatgattcagtgaagaccacctagaccataaccttgcagagtggataattttaactcctttaaaaatacacatcatcttatgatggttctaaaactcacacattgaagctttccctttttaaatgaaagaagaaagaggagagcaaacacattcattcattttctcattagtaaatcttcactttggttaatattaaaactattataataaataataaataaaaataatacttattaagtttattatgcagcaggaagttttcattcattatcttacctgatcttatcaacatcaacttattccattttacagataaggaaactgagctacagcaggatacatgacttgccaaaaaccaggcagtctgaagcaattcaaacccaggtatgactccagaacccatctcccattttgatgtggactgggactagatgcaagacgctaacttttccatagactttcttccagctgtcatttaatgcaaagacctcggctgtttggctgtgaaactgtaaaagtcctttccctacatcgccagtcacaccctctcaaggagaagaacatcctggattataagattcatcctgtattacacaggtcccacacgacctgcacaagaatccagccctctaagtcttcccgtcccattttccctccgttgctaatccttggttttgcggtttactccaatgtgttaattgacttcattccagatctcctacctataccagttcttaatctctcttcttatccatcctacaatgtgtgtgatttggcagcgtgatgcataaaatggctactaccactaattatatttgaatttgttaggattcataaagatgttttacatacattagtctattaatttatcataataaacctgtgaagtaggcattattatcccaaatcacagataagaatgctaagcctcagggagactaaacgacttgctgaggtcacacagctaataagtggcaaggtttcaaggtggagcagtgacaaggaaacaacccattataccttatgagttttctaaaaatatcaatataatatttgaggaaataatcagcccattagattattttcctcccccttactcccccacacactaatgaggctttaatcatactctctccctttgtgccagctaagttgctgccactctttgagaagaaggtggaagcaagatatacttgttccaaaagtgatttcatgctttttctactttggggacaataaaagcaaattaaattcactgtgaaagaatcagcctcttaaggatgttccaaggaatggtactctaaagattctgctaaatgatgaaactgaggaatgactgggttttaaaataaggtagaagtcaaagtgatgatagcagctgccttatgtttctttctttctggtttttaaataaaattaagatataactactccaactaccacaaacataggcagaactctggaatgaattacataattccacctatgtcatgtgttaggacctctagaatacctcactcgtggtagccagaatgtcaatggaagttttagaggcttttttctaagtatatgcacatattggcaatgtgtattgattattgaatgaccgttgtcatatgactcagtcatttctcaatgacaccctttaatatgaataggaagatagtaccaactgtcagcatgatcatcatggggatgagaaaataattatacaaatgctagaaaacaaacttctcaaattgctacatttcctctcaagtattttctcacctttaaatttcaaattatttaaagtattttcaattacttgaatcaatttatctcctaaaactttaatattcaccccaaaacagctgtatctcatagtccctgacaattttaaaacttcttattttttccttttctcaaaatcatctcatcaaagatgagcaaatgatggccttttgccaagaacttcactggagagcaagagtctttcttatttagcttggttagaaaccttgaaaacataaatattgatactgccccttacgacagtgagaagagcaggctgtcttgtactaaaactgaatataattttccactgggagaaagttcctccaagtctgcatgatcaaaaataacaatatgtttatggtgatgtgggcaatgaatgttaaggggatttaccatgtgtctccagggctgaaggaaaagtacgtacatactcataagaagagaaatacaaagctaggaaaacagcaaggagagatgaaagcaatattcaaagtcatgaggtggactactagagtgcagctcagattttagagatcaggcatataactgcattggggagtaaccttgaatagtcaccttttcctggtcttggatatgaccctttctgaaacctctgggtcaaactgcctagggtctaaactttgtatggctctggctttaattagttctgttttgggctgattgtccaggctgaagcaattttgcagtcatattatagggaggtggctttcttcaagtccactttggaattacatgcccttaacttcattaagtctgtatcctaggccagccctccttgttgggcactgttcaaaaatggagttccttgtccagtctatgtctgccaatggaattcacacattcctaatgcatctctgtgtgaatcggtcctctgttccaccaatgcctgttggtggagtgtacatatgtgagccattgcagagaacagaggggcaattcagatgctgggaacatttttagaataatgatactcagtggaattccacatagacttgcattttatggctatgggtcacttttgtcaaataaagcatgtatttacaatactcaaacatttaaagttactgaaaaatatttaactcttttgggtttggggtttatgcttctctttaatgtttatataatttaagttttgacaatagaaaagctaggctgaaaggggaaacaatccaactgcacacacaaaagagtgcctagatagaagacggacagcataggagattgagcatctgtggatcagggtaagtcatgctttctgctctgatttattcatccatttagtttttcattcattcatccatatccatagcccctctcatatacaaaacaaatgtagtatcaaaaatgtttctattgtaaagagacaagttgctcaaccttctggttcttcatttcttcatctataaaacagggggactgttaaaaatgtcataatattctggaaatatttaggtaatacataatcatgacaatgataatagtaattatacctgtaataacaacaacaatccaacaagtcttttctgccaacagacttatgccaacaacttgatggttaagaggtcctaaccccaaatccaggttagatctcctctgtgcaaagattaggctaagttcaaccactccaaggctttggagcgggtcatagctttttctgtgatgatccagctccctgagagggcctgaaaaaagctaagagacgggcacggtaggctgtacctgcccttagtgaactcaggagagccacgtcttatattccttttctatgaggccagaaataaactcttatatcagagacatcaggaaatcagaccttatgctacatgtaccttacaaagctttgggggtgaaaacacaggaacagagttatctgcagctcctcgaagagaaatgagacgtatggcatgtttgccctcaaaccacaagaagtgcccttaatatctaaggctccagagaagaaaagcaggctgtgatgagtggggcttggagcttggcttccccatcaacgagccaggagattggatccaggagtgaggacactggatgagcacttcccacttagcaagaaaccaaattatcagttcctcttcccagcatgtttcaaaggtgagtttaaaatctatatctcctctctccttcaaagttgtagtttttacaagaattttagaaatatctcagaaggtcttgccgaatttgaattaaattcaaggtaattgtatccagaaggacaataaccactgatgttgcagggaatttttccacttggaaaagagccacggagaaccacaagggtgctagatgtcagcaactgctttttatatgttttgaaacacagaagctttgagtttaatgtctgtgtcatatgctaaacacatgtgaccttaactaaacagcaccaaaacccaccataaattcatcgtcaaccttaatggtttcctcatttcaaaacacatttgttttgtaagttaatgccttaaggccacaattttaaggcgactacacaaagcttaaatgaaaaacatatcaggatccatatggctctactaccacacacacatatatacagtttcactgtcattttaactcaaaaggggagaaattttgcacacatttgggtcctgtgcttccgctgccatggacaatttttggtattttcagaatttcccgtactttaccaagcaagaagggcaaagttaactggaattatcttcctttctttgccagtttctgtctatgaatctccctctctctctctctctctctcacatacacacacactctctttctctctgtgctctgtgtgtgtgtgtggggggggggatggtgtgtgtgtatgcgtgtgtgtttccagaagttttcttcagaaaaaaaggccacatagaaattttgaagcccctgtaaaaaaggagagatgatttttaaagttacttagaagctggtattttcttttagactttcctttattttcaagtttatgatccaagttcccttgattctaagaccagctcaccctcctaacatctccttccagggctagagaaattctgaacaacacaatttccatgggaagagacaagaagcaatggaaggaaggaaaagcaggtgagagggaggcgtgcagacaggtaggtcctacctagtactcttctcccccgggctctgcctgcagctggaagcaaaccatggactgccgcttccactcagccttccgcgtgggctcactcagacaatgggagtttcacttaagatacatcttctggcagcatattagccatttcaaaaaaaacaataggcaagatgaagttttgaaccctttgtttcttacctttttccccctaaaatgtagacgaaggcaaatacaggggacttttggaggaaaatggcatatgcaatcatttagtaaatgttttagtctgtatcttagataatctgacacagtgaaatattcataagaattgggttttttatgttctttttttttgaaatggagtttcgctctgtcgcccaggctggagtgcagtggtgcgatctcagctcactgcaacctccgcctcccgggttcaagcaattctcctgcctcggcctcctgagcagctgggattataggcgcccaccaccacgcccagctaatttttgtatttttagtagagacggggtttcaccatgttagccaggctggtctcaaactcctgacctcaggtgatctgcccacctcagcctcccaaagtgctggaattacaggcatgagccaccacacctggctagttttttaagtgttctttatctgtgcctaagtgcctgtatttattattattgctcaatgtaaagcagtaacataatcgtataatttaatataacatcatgtctagttatataaaaaattcataataatctactctgtgaaaatgtaaatgatcatctgtttccattggaatacacatattctagtatatatttaacatattttatttcatgttttattttacatagaaataagcttctacttccctaaatattcaatatacaagtttttaccattgtttcactcacagcgtaagataatgaggtttacctattgaatttctctattttttttaattttaggattttgacaggtgctatgccttaaagaaaaaagaatacatcagtacccaaatttggtgcagtttattgatacagttgaggcttattcaaggatctgatgtagtcctgagtcagaccaagccagatccttcatcgaagcacctcgggtttgtcctgtctgtacagtgtacacagcacttccagatacatcctcattggactctcatcattacccccagaagcagaatgtggcagctatcaagattcccttttaaagatgaaatttagtgccatgggtctccaatcttttattccacctgggagagggcaaagaggcacttctaaattttgtggcaggggcaaaaaccaaggggagaagttggcattaagcacgtacaacatcttttctctctaatgacctggaaacattcaaaaaagtaagtagatatatttcaaaggaaaaattctccctttagggtaatattgatcatttattcattttccattcattcaacaagttgtagagctcctactgaatggtacacctagttctggtgacatgaagttaggagggaacaaagcaagaagcctgctccaggaaaaccttcactctcatggaatatgcagagaaataaatgaggaagatgatctcagaaagtgatacacgctacatggaaaacatacagaggggttggggtagtaatgctttctgtatgggtggtcggggaggtgacatttgagctaagcttttaataatcagccatcctggcgagtccctgatgcaggaatgagctgaagtagggcaggccattttggctgaatgtcggcagccagggagaaatgacagaagctgcagtcggggcatgaaggatcttcaaggccatgggaagtgttcaaagtctgaaagagaagccaccagggtgtttctaggaaggaatggtatatgctctgatttacggttttaaaagaccactcttcctgctaagttataggaggacagaggtggaacagagggaagaccaatgaagaggctatttttacagcccacgtaagagatgacattgtctgcctggcagaagcagaaagaaaaaaaggagccagagttgagatatattttggcggtagcattgacaggatttaccaaaggactaggtgtggaggaaggagaaggaaaggaaggaacaaaggatgatgcttaatccttctggcttgagcatggaagagccatttgcagggttatggggcaaaaatcaaggatcttattttggattattttaaattagagatgtttgtgagaagcccaagaggggatacatggtaggaaattagatacatgagaccagattttaagggagaaaagataggtatttggaagtcatcagtgtgtggacagtggttaaagccatggggctggacgagagtatctagggaaagagtatggctagaggagagaggagatctccgacttgtaccctgatcttggtataagaagaggaagcagcaaaggaatgcgagttgctatcagagaaggaggacccaaaccataaagttagtctacatgttcagattagttccccaggaagtctatagataagggcaaataactttatcaattatttcagacacctctactcttctagctgataaaaaattttatttttaccaaagtcacctacctataggtgcactcttagaagctagtacgttgcctactttaaagtcttacctttgctccagtgtctcccactccacgtaaacccatcggcccagggggtcctggtaatccacgaggtccctgagatgacacagtaagggagggagtgagcatccttgtagtatgcaacactcaaaaaggagggagggaagaaaaaaatgtcccacttacaggcacaccaggatagccatcacctttgagtcctggagcacccactggtccccgagggccttggacaccctgggtaaattccaacatcagtgatatcatgagactcaactagaaaacacctggtcaaacttaagcataacaccaactcaatatgccaacggtcgatttctaacccgggagttagaaaatgacttattgctagtactttaattcttaaaattataaatttttagtgcatcgtaaatcaagaagaagtataaaaaagaaaatttattaagcacaatgtgagaagagtagaaaagaatacatagcaaaattttgagtgtgggataactagtttcctattgttgcgttaaatctattctcttcattaatggggcccgaattatacggggaataaataaacccagatgaaaataaaaacacattaatttttcaaaaacaagttatgaagggatagagtttgtgactcatatcttgagacctagggaaaagttgtaaatattgttttacagtgatgaccttaggcatcaaaaacttttagtaacagcccttagtctcctacagaaagagcagggaggggtgattattgtcctttagacaacagagttttctaagacttgtaactgtctcacaaacagcaatcagaaaatttctgactcaagtaaaacggggggagagaaaaaaattaagaaggatcttttagaagattacctacaagtggccgggtgcggtggctcacgcctgtaatcccagcactttgggaagctgaggtgggtggatcaccaggtcaggagttcaagaccagcctggccaacacggtgaaaccccgtctctactaaaaatacaaaaattagctgggcatggtggcgggtgcctgtaatcccagctactcaggaggctgaggcaggagaattgcttgaacctgggaagctgaggctgcagtgagaagagatcacactactgtgctccagcctgggcgacagagcaaggctctgtctcatttaaaaaaaaaaaaaaaaaaagattacctacaagtccattacacttttatttaaaacttgtaatacttctttttacaacatattccactgatctgttacaccgatctgttgttgatgactcttacaacagcccttgtcaatatgcagcccttgttttgataaagagctgctcatgttttaaaatatttatggtttttctttatattgggaggaaactctaacaacaggcagacctttgttttgcaagaatggagaaagaaagtagcaggactcttaagaactttcctcatatgcaaacaaactcggagatcaaattgccattattccaagtgaaaatactgcccaaagtccaactctcaaaaactattctcaactatactccaataaatgaataattgactgggaacaggggaaaattttttatatactctttaagcaatcagaaactttattttaaaaaccaagaatgcaacagctgttatttcctattaaatctaaaaggctgtttttatgtggttaaccttcttaagaatgatcatctttaggaaatatgtggccacttataaaaatttaacctactattcatcatcaacaaaaactcaaggtgattttttaaagttgaatgagagaaaggaagcccatggtcttcaggacaggtaaatttgggtgtattccaactatggggaactggtcacttctcagaaccaattttttatgctattccagttacatttaaggatgaagctctaaacatctgcatatgaaacttgtcccaaaataagttttccacttatctccatgtttacacaaggagagggccaacaacaaactaaagcagtaacagctccccggttgaattaaaaggaaaagaaaattggaatcaaaatttacttttcagtttttatttctacagtccaaacttagaacaaattgtcagcagctgctcttgtttaacgtctgacaccacagcggaggggaaaaccatgcaaacactcacagtttacaaacatcctttttatagagatctttgtccttgctcctgcaaaaatctcaggtagcttgttacttctattattaacaggaaatatcaaggagcaagaggaggagcaggtttttattttggactccttaccatatttttatagatggaattttgccacttggcttttctgtactggattcaaggaaatgtcctacaaagttatttacttcaaagtgtttctctcattcaatagaaattagggtaaaaatggaaacctagtattttgaaatcagctttagggggcatctgggagacccctgaagtattacataaaatgaaattaatgtgctaaatcttccgtcagaccttcaaaggtgtgtatgaccctcccaaaactgaaaaactaatgaactagggaagaacaacagaaagagtatcattagagtccaggggagtagcaaaatgattgagtgaagaggcaaatatctttaaataccatcacctataatgcctaataatcatcaacagaaaacaggtgaggcctataaactctagcagcacatttaattggattgtattcctattgcaaacagaagtatatgtagagagagatgtataaatcggattgtgaatacacagcttcaatctatcaaaattgtcatgcaaatataattgatcaaggtcatagctgcagttttcaaattagaaaatttgctattgtccccatgagctgtctatatagcttgtgtttctaaagagagtggtctacatagtttgggttaccttgggatctgtgggaagtagacgaacaattcgtccaagtttgcccaagattttcccagttttagcccggaaagtcatgcgttccaggaaccccttcaatcccgggcaaactagggcagctgtcactctagcagggaggactgttaaagcaataaaaacaggagaggctcaagattctccctttacctttaaaaagaaccactccaatttatgtcagtttttatacaacaggttttgcatcatattttatttaaaaaatgactccatgttttcttcttttaactttgaaggtcatcagtttagtacttgaacccttttatctagataagacaacttagtatgggagaatataagcaagtttcaaagctacgtaacaacatgctattgattttaaaagtgctaatgatggggccctgaagcttgtcctcataaacagagatatgctggttgacacctaggaatgctatacatgctgaattttgctgtggtgctgggtatagtgtgaggaggaaaaatggtgcttcgttgccatgaaaaaccagatatgattacagaaacctggtttcttcttatttgtctttccctttgaaataactcaaaaggataaataaagcaggaaatttttattcagcaaagcttccaagcacacacgcttttttggacaatgttttgcagaatagatacttcagccactaatatgtaaatgaagaggccagaggccatttaatgccttgtatcactgacagtgcaaaagagcatttttcaaacaattgtctaatcagcaaaaatttaaccataagagctacttttccccacaagtatgaaaaataaactatgtgattgcttgtttttttaaaaaaagggaatagctatattcttacattttagttaatcaatgtagaaacctcacaagtagaaaaatcaacttatgcattaaatctaccttcatttatttcagatacagaaaaacaaaaagaacatgaataaagcatacctttggtcctcgaatagaaagtccaggttctcccttaaatccaggtatcccaggtcctcctctatctccctgtacatttcaaataacatttcacaggctacagttgtgcgagaaatcacaagcacacatagcaaaaaaaaccattggccactctgtaaagagcttaatctgtccatctcagaccttgagatagtatattcttcaaacatatttgaggggactttcaaatcctaagtaaataacacctgtcagtaaagactattactgctgttgggagaaagtccattgaaataatatgtggcaattcagactcaaatatttcgactttaagaatggctgagaatgctcttaaaattgagtgaaggccaggcacagtggctcacacctataattccaacaccttgggaggccaaggcaggcgggtcacttgaatccaggagttcaagatgagcccggccaacatggcaaaaccccgtctctactaaaagcacaaaaattagccaggcatggtggcacatctgtaatcccagctatttgggtggctgaggcaagagaatcacttgaccccaagaagtggaggttgcagtgagacaagatcgcagcactgcactccagcctaggggaaagagtgagactgtctcaaaaaataaaccagtcaaccaacctgagtggatatctcttctgctaaactcttcaattataaatcctggtagattcttctgaataaatgttctaaattcttacctgcattagggtttaggatttggaagacgtaatgaagggtaaagtgacaagcttgggaccaagagcacaaaatctggtttctagtcttaactctgctgctggctgtagtttgcttatctgtgaagtttcagagttaaacggaatcatttctaaggctcttccaaaactaaaattctagttcactggtatcatgatttttttttctccaactgccaaagggtcaagaaaaagaaaataatctccaagaatatatacctttggcccaggtggtccaggaattgatgttccaggcattccaaaagggcccataatgcccggttcacccttaaaaagagcaaaatgctcactacatttcaagcagagaaagcacatatagagacaatattaagaaaagtacagaaatgtctgcagatttttaaattatgttatgacctctatctgtttcaaagaccaatgtgaaaataatttgagcatcttttgtaaccactgctagttattgactagtaagatttcagtgcttttaaataactatgttcaattaatcactgaatgttaggaacattttatctcttgtgcagcctcttattagctaataaaaattatgcaattcatggtgcttcctttttgtgttgtatgttgggaagctcaaagagaatttttttttcaatatagcaattatcttcagcaaatgttttagggtgtacttctaggttataactcttttttctttgttgttttattttaatgaccaaaggtaaaatagtcttccattccatgttatctcacatcctttttaagaagtagaacccctatgggctgggtgtggtggctcacacctgtaatcccagcctttgggaggccgaggctggcggatcacttgaggtcaggagttttgaggccagcctggccaacatggcaaaaccccatcgctactaaaaatacaaaaaaaaaaaaatagccaaaattagccagacatggtggcatgtgcctgtaatcccagctactcaagaggctgaggcaggagaatcactcaaaccctggacgcagaggttgcagtgagctgagatcgcatcactgcactccagcctgaccaacagagcaaaacgctgtctcaaaaaaaagaacccctatgattttaaaaaaatgacatttttaatagaaaattttaaacatttagtgggggagatgtctaatatttagagtctcaaagactcaatctggagcaacaggtaattctcctgttccatctggatctagacaagtgattctcagattttagaagcagaggaattatcaggaaagtttggtaatgcacagttctgggttcaaactccagagattctgattcaatagctctagaggttggggcccaggattacgaaattttatgaagcacccctggtgaaaaacactattccagagcaattgtcaccgcacaccgcaaggtgttccaaatgacccactgggatataaagaaaatattacaacttgtctctatatttttatctcatcaattaaaatttcatttatataaattcataacatattagtatgatagcttataaacagaaattacaattaaaaaattaaaaatctgtggcatgtgatcaaaattttactggaggggtttataatcaaaacagtttggaaactacttctctacggtaggtgggccaaatccagcccacccccttgttttgtacagccttgagctatgaacggctttcacattttcaagtggtcattatacaaataactaaatatcttccattttgcctcttgggccacaggacctaaaatatttactatctggacctttaccaaaacaaacaaacaaaaaacactgtggagatgagtcgtggagaatgagctgtatctatgctatgtctaaacatgaccctctaggttttcagactgctgactactcctgcctccgtctgactcatgtcctctgaaaattcaattgcatgagcttccttttcagtcatcctgcttcctccagcagggactccatcagtcagattcaccagtgatgactcctgcccagggccgtgttcatcttcagagctgaagcctcccgctgtattgattagccaatacaaccaacaagctgagcacactggcccactgagacccagttcttgccaaggcatgtatgtgccagtccttaaatccaaacctggaaggcaatggcacaggacatgacaagaatcgggaaacacaaaaaaaccccatccaagcctttgacaaaggaacagaacatgaacctgttaaaattcttcactaaaaccaaaggaaaatcaaaattatgtctctagatttaattttacttcttttttcaaaaaaagaggtcaattacttttataccatgaaaagtatcatggagagtattaaaatacaggtctcaaataccctgtattaaggggtgattatgctttaacatatggcaattcttcaccttcatctttaaaaacagctttatttcaaaacacagaaaaatgttcactttgaaatagagtaactaggacataaagactaatctgttattaatactaatacaacacatctgttacatagtggcacttctcataatgtgcttcctgaactccctgcagcacagggcatttacttgagaagcacagattcctgggctcactcaccactgaatccagagagctgaggatggtaacaagaaatctggatttgtaatcatccccaggtgataccgatggacactgaatggacactgaagtttaagagtcactggtgtacaggtgatgttttgtatctgatgttgtcagcaccattttttaaaaatgtgctttttaatcatctggtcctaaaatatactccttgtctctttctcacaattagtatctttctagagacatgaactctcttacgtttgcagtttctgtttcctgacacattcaaatgaccttaatggtgggtctctgaggctaagtcaggacacatacttaattgctcacctcacaatccccttcgcttcttcctcagcactgtgttatcaacaatttaccaggacatagatcccctacttcccatttcaccatattgatttttttctctgaataattcgatgtattcaacacttactatataccaggaaatgtgctaagtgctttattaactcttttagtcttcacaacaactctgtgaaatagagcatatcgttatcttctttctataattgaagcgacttgctccaagaggttcatggcacaggaggatgcaatcagccttccaaagaagagccttcatcatcactgtgctgcctctcactctcaggcttttgggttgtttagcaaagcaagattatgaagaactgatagctcctatggtcccaattttatcccaacttctgaatatttggttgttactagagaggactgacagacaaattaggaacataagtatttctatgagtattacatattttatgcaatctattccattctattgtggtctgggaatagtatgttttctataggtttcttattttggggtatttgttttgtacttgttgggaaggaaacaaggaatccaattttcagtggaaatttaatactatattaaaaccagacacaatacaaactcctcaaagcgtaagtcagaatacaagaaacatacctttggtccttcgggccctggaagtcccctctgtccttgatttcctttgctccctttcttgccttcgtcaccctaacaaaataattatgaaaatatagattttcgtatggtattagcaacctcccctaatctagcaaggaccatagcggagccggattctcgactaataccaattttaaagtggtgtgccctgagcacagctcaattgcgcaggattcgtcaatgttcttgaggagatcagatgacttcagattgttcagcctttactatttattcaatatgatttgctatttttcaaaaatctaagttttgtatctttcttttggaacttttgtttgaatttatagttcattttcacccttggtctattaacagatggttctgagacattcacagtttcagaaatgagtactatctatgctttttcatgctgtttttcaatttttctatttcaggtttaaaagatgaaatgagacattttaaaaatcacagccctatttcgtcctcactggggagtctaattctttcccccaaaagagaccaatagttttattggcaggaagatgcttgagcattaacctggggcagagctaggaactgactactagatgttgcccagcagggttgtgtaaaacagtgctctcccaaaagaattcctttaccttcaaaactatctttcaactagggttcaactgcaaggcgccatatccagggatgtacacagctcaacaaacgaaaaaaaaaaaaaaaattcctcgtggtctgcagctgaggctatttaaatatttatactataaattactataccatggtttttaaagttgagcaacagaatcacctggagagcttgttagaccacagattgctgggccctccacccagagtttctgatttagtaggtctgcactgaggtccaaacatttgcatttttaacattcccaggtgatgctgatgctgctggttcagggaccacactttgagaatcattagactatactaaggtcatcagcaaagcaggcactttattaagaagagatgacctcctgtagaatccacagaggtttccatggtccacactaatgtaaagcagtggcaccggtgtaaaaaaaaagagttgaatgtccaaatatcttatatcattatcacttaccagtagagacaaaattcaaccacaactctttattttcttccctccactaccactaatttaggttattgacctaaatcaccccagaaatgaacagcaggaacccaattacatgtaataaatcgccaacactgaaccatggtatacctgggctatgtaacatgttcctaccactcttctccaataggctttcataagccacaagtcacctcaagccacaaattcagtagcctctctttccaatgcacattcttcttgccttattggtggcatctgataccacccattgctttcatcttgaaatcctttctcctcagtatccctaacatgctaccattctgcctattctgtagagttgttgttctccagctacctcacaatgtggggtttaaacctcaactctcttccttagagacattgttcattctcacggcttcaattattaactccaagcgcctattttccaaaaacacatcctaaaaacaattctcctgaatgttagcagatcggcatttctaaaagtatatttcacgtgatgatgttatcccctccacctcacccaaaaaggatccccgagactggtaaatcaataaacaaaaatgtttaaaagcctacaaatatatttaaatttcatgtcctcacatttaagattaaggattcaattttagtgagtatgttcacaagacatcaattactattttagtagaattatgaacagaacactaatatgtatacaaattttatttttacttgacttgtatataatccataacaatctttacatgggaattgataactacacataaaaatagaaagaagcccaggcgcggtggctcacacccataatcccagcactttgggaggctgaggcaggtggatcatgaggtcaggagttccagaccagcctggccaatatggtgaaaccccatctctactaaaaatacaaaaattagctgggtgtggtggcacacacctgtagtcccagctgcttgggaggctgaggcaggaaaatcgcttgaacccgggaggcggaggttgtagtgagccaagatcgtgccactgcactccagcctgtgggacagagtgagactccgtctcaaaaaaaaaaaaaaaattgcaggaagacctggaatcttaggggctataggttatgtcactagttgtcttatcctattgatgaatttgtatagtctcatcttaacatataaaaatgttattcaactagcatttctacagtggttaaaatagatttatgccaagttgtgaagtgaaatggccattcaataaagtgatatttcttattgcatgagattttataaagaaaatttatggactgtcaaatctcaacgatgtatctcaaggcttcttttccttcctatgtgttttttaaatgtcaatctgaccatttattgagaaaacgtgtgtcaaactcttctctatgctgggtcttacaatagacgttaggaaaataaaagtgaatcatatacgcttgctgtcttccaaaagcttccaagacagtattcatacttttaagccagacataaacacattgacatagtaagaataacaatcaaatttcttctaagttggctcctcagtatgaggaccagaacacaggctgcttccaccaacactgtcatttccataccttggggccaggctgtccttttccaggtggtccttctgggcctcttgctcccggaagccccgcttctccctagagaaaatgacactgatgtgttagctgaccctccagtagacagactgtacgtatcatcccaccttgtctccttttatcattagtggattcagctgagactctccaaaacacaccataccttcactctagtctcaaaatcaatttggaagtttataaacttgaaataaagtaacatcaaactccagtttaactcagagcagctgcaatatcatgaaaaagtaatttatcagccaatttccaaagcaataagctcattttcttttggctcttcattcgcatttggtagattttttaaaaaacagggaagaccttcagcctttccatctgctgtttttttttttttttttttttgctacttttactgaaaaatgagtatttcaaatgtcaacacaaaatacttcaggaaatctttacaaaggccttatttcctgtatgcatttacagacttgcctcttagggggaggcggggggagtggctttctcttaagtttaaattaatgtgctttctagaaatcctgaagaaactaggccataaccaaaacaccagacagaaggcagaggatgtgagacactatctcagcctttgaataggccactccttctctcagggagaagtggaaagggacatttgggattgtgagatattttttcttaaagaaactaagtttgtcctgaatggttttattcgagctcctgcaggaccaagatatcagtttggttcaacagttcctactccagtaatacgaaaaacttggtgttaccttcttccctgcagctccatcttctcctggtactcctggttgtcctgggagccctattgagcctggctctccctggtgaatgaacaaatattttatttccctaaagttcatacctccattctgaggtacttgcaattggatgtatcttacagtgtctgagaaaagcctccgagaaatctcattagcaattaatactaaactatttgatcttgggaagctacttaacatccctaggccttagtttttgattctatttttatgggctgaattgtgaccccaaaaagatatgttgacatcctaactctttgtacctgtgaatgtaaccttaattggaaacatggtctttgcagatttaatcaagttaaaatgaagtcattacaggggggccctaattcagtataaaaggtgatataatttggctctgtgtccccacccaaatcttatttgaattgtaattcccagtgttggaggaggggcctggtaggaggtgattgagttatgggggtggacctcccccttgctgttcttataatagagttctcatgatatctggttgtttaaaaatgtgtgtgtagcatgccccacttcactctctctcactctcctgctcctccatgtgaagatgtgcctgcttccccttcaccttttgccaggattgtaagtttcctgaggcctccccaaaagtcaagcagatgccagcatcatgcttcctgtgcagcctgcagaactgtaagtcaattaaacctattttctttataaattacccagtctcaggtagttatttaaagcaatgagagaatggactaatacaacgggtactataagaagaggaaaatgcctcttgaagacagacacacagggagagcaccatgtgataagagaggcaaagactggagtgagcgtctgctaggcaaggcatgccaaggattgacagacaccctgagaagctaagatgagaccaggaagcaatctcccttacaggttttggaagaagcataaccctgcagactgattttggacttctagcctctagaactgagagacaataaatttctgttgtattaaggcactcagttcctagtactttcttacatcagctctagaaaactaatataaaagtgaaataacaaatttgtgccctaacaacacttccagctctaatattcagtaattccacttgctttcgagttaatttacgattagtaataaatcctttaaaatgttcaggaaaaaaatatgctactttcaatcagtttaaagcatctttatggcatttattaatagcaacaaaatggaaaataattgaaagcaacttcaactaacctaaacaagccagtgaaaaaaagcacagtaaatctaacactaagtagatggaatgataaagatgagagaagaaaataataaacttgaaaacaaaaagtaagaagattcataaaacttaatgccttttttttttttttgagatggagtttcgttcttgttgaccaggcttgttcagtggtatgatctcagctcaccgctacctccgcctcccgggttcaagtgattctcctgcctcagcctcctgagtagctgggattacaggcatgtgccaccacacctggctaattttgtattttcagtagagacgggctttctccatgttggtcaggctgttcttgacctcctgacctcaggtgatccgcctgcctcagcctcccaaagtgctgggattacaggtgtgagccaccgtgcctggccagtaatgcctttttaaaaactaataaaagtaaataaatttctaataggaatgatgagaaaaaacctagaataataggttttttaaaagatatcaataaacaatatcaaaaatgaaagacataactatatatatagtaaaaatgttttaagtcatagaaaattggtgataattttttcaaatgtattggaaaacaataataatctttgagaaaaatatgaattatataaatgctgtaaaaagaaatgaacaagctagataaaccaataatattaaataaattgagtcagtgattaaaagtctctactttctctctctccaagatcacaagcttagttggttttacagtcaagacttaccaaacttctaaacttttgaagaacagttattccctatcttatacaaacatttctaaaaaaaatagaaaagagggacgtctacctaatttattttatgaggcttataaagccttttcaaaaacaattatacaatggcaagacaagaaaacaaaattatagaccattctccctatgagacatagcacaatttaagcttccaatcaaatgctttaatttcttccagtgcctgtacaaagtttccaggtcataatgcagggattgagaaaccagggcaagttcaggcatctctctaaggagacaaacatgcatctgggtgaaccaaggtatcaaaagttcacagagtagattaccagaaagagttacacagagaaaactataagtatctgctgagcatccatcttgagtattcagctgaatattgctcagtacatgtgtgtgaagaaactacccaaggccaggaaaacaaccaacttaaaggattagagagaactgacattgaaccaggaatagtgcctatttctactggcaagaaataaaacctcacaattctgagggcataaattggagttctaaaaagggtcttacctcaacagtgggaaaaaattaaccctagactaaatgttgctgtagtcttacctaataaaacttaaaagcaagacccaaatgggtcaatctgttttcaagtaactaaaaaacatccaagaacaaagctcaaaatagaggaatacaaaaatatccaacacaataaaaggtaaaattcacaatgtggggcattcaataaaaaagtattcagcctgtacatgcctgtaatcccaactactcaggaggctaaggcaagaagacagcttgagcccaagaattcaaagcaagcctaggcaacatagcaagaccccatcttttaaaatattaatattaataataatatttaatttaaaaataaaaaataggcgttcaaaaaggctgaaaaatatagcactttgtgttgagaaaaatcaatcgattgaaacttatccagaaataacaccagtagtagaattaggaggtaagaacattaaaacagttattatgactatactccatacagtcaagaaaccagaggaaatttaaagcatgttaaatagacaaatggaagatatatgaaggatacaaattaaaattttagatttgaaaattatgatgtatgagataaaaaacactggacagaattaaaagctgattagtgtcatggaagaaaagattagtgaactaacacatatagcaataaaagctatcctaaattaaacacagagagaaaagagactgaaaaagaatgagcagagcaccagtgaactgtgaaataacctgaaacatccaaatagccaggccaacattactaaagcccatctctactaaaaaatacaaaaattagccaggagtggtggtgccgcctgtaatcccagctacatgggaagctaaggcactaggatctcttgaacccaggaggcaaggctgcagtgagtcaagagcatgccactgcacttcagccttggtgaaagtgagactctatctcaaaacaaaaataaaatccaaagataagtaacactggagttcctgaggtgaggaattgctatttcaagaaatactggccaaatattttccaaatttgatgaaaactataactcatagatctaagaatatcagtgaaccaagaataccaatgaacttcaagcacaagaaacatatctaaggcacattataatcacaccactcagaacccatgatgtacaggaaatctcaaaagcagccagagaaaaaaagacatgttgtgtagagaaacaaatataaggataacaacacatttctcatcagaaacaatgcaagtgagaagacaatagaacaacatcttaaaagtactaaaaggaagaaaaagcaactgcacactataattctataaccagaaaaaataataagcaaagattttttttttggaagttgatttggcaatttcttggaaagctaaatgaatacctaccttctgacctagccatttgacttctaggtgtttacccaagaaaaataaaaacaaatgtccatacaaacacatataaaaatgttcatttataacattttatttatgataaaatttataaaaatttataaaatttatttaaaatttttatttataatattccaaatctggaaaaaaacaaaatttatacacaggtgaatggataaataaattgtggtatatccatataatacaatactattcagcaatacaaaggaatgaactgttcatatatatgctacaacatggatcttagattttgctgcattaaaagaagccagaaaatatcatatagtatataattccataaaaatctagaaaatgcaaactagtctatgatgacaaaaaacagatcaatggttagcagataattggaaagcagatctgtgggaagcctattagtgaacatagaagaagttacagagggatagaaggacagatggtaacttctgagggttacagaaatatttatcatcttgattgcagtaatgattccaagggtatacacatatctcaaaacatcaaattgtatactttaaacatgtgcatttattatatgccaatcagataatacagttattaaaataaaagcaaaaatcctgaataaaagattagtcagttgaatgatcatcataaaaaagtacacataatgaattgagtttatctcaagaatgcaaggatggtttgacatctgaaaactctgtaaatgtaatgtatcgtattaacaagttaaaagtggaaaacaacacaattatcttagtagatgcataatttgataaaatccagtaatcatttatatttaataagtaacttttggtacaaccaaaaaagaaggaagcttccttaacctaatgaagggtatctatcaaaaactttcagcaaacatcacacttaagagtgaaattttagaagcacttcttttgaagtcatttcttttaaacattgtacaagtgatcctagcagtacaaaatgataaaaaaaaaatcaaagaagagctaaaaaataataggcaaaactttatattcagacagtatgattgtgtacatagggactgaaaaagcaagagattccacaaacagatttcacagggtggctggatacaaaatcaacatgccaaaaaacaaaacaaaacaaaacaaaaaaattctcctatagacctatactagttagttaaaagatatagaaaaaaaattcacaattataaaaatttcttcaaggtatctggaaataaatttaactaaaaaaatacaagacctttatggagaaaattacaaatattttcttgaaaaattacagctttactctgtggtgtgaaagacttgctatttaatctgtagatttagtgcaaaccaaatggggtatcctgttaaatatgacaagccaaccctaaaacatgtatcttagagtcaataataaccaagaaagaagatgagagtatttttccttttagatgacaaaatatattataaacctattataatcaagacaaggaggtaatagcactgagagatataaatagacaaatggagtagaatacacagctcaggcactgatactcaaaatatggaagcttcatatatgaaagaggtggtactgcaaatcagtgtggtaaagatggactattcaacaactgattctggggtacttgtttatttatagtaataaaaaatagatccctacattgacccatacacaaaaataaattccatgtgggttaaatccctaaattttaaaaacaaaacactaaaattttcagaaaaatgcataagaatatctttatcaatctcaggtcaagaaatgttttaaaataatattcaaaaatcacaaatcacaaagggatagaaatatagaatttaaaacttctgtatactaagaagtactctaagtgaaaaaaataagtcagagcctaggagaagatatttgcagtttgtataacacagtaagatatatttgtacacacttcatatttgcacagatttagagaaaggaacatcatcgcctactgctagcaggaaggtaaactggcacaagcattttggacaagattttggtagtatcacaattgaagactcgcacgctctatgatcttcccattctacctctaactgtctatcttctacaagtcaagaaacttgtcctccaacgtgtgcaaaaggaaacagaatgtttgtggcagcattgttggcaaaagcaaaaagaatgacaagcaatttaaatatccaccatcatgaagatgaataaatataaaatgagatattttcatacagtggaatactataacgcgattaatatcaatgaattagaggcatacaaaaacacaaataaaacataaggctgactataaatatattgcagaatgatatatcatgtaaagtttaaggacacaaaaaaagtgatatatggtttatggataaaaatgtgtgggaaattataaaaacttcaaaagaatgataaacaccaaattcataataatgattatgtgtgaggagagaagggagggcagtgggattggggagtgccagcagggaccttcagccacacctacaatgtttcttttaaaaagtctagagtcagtgtggtaaaacattaacatttgataaagctgggccgtggaatacataggtgctctttgtattattctctgtatggtgagtatatttgaaatacttctttttttttttttaagatggagtctcacttcgtcgccaggctggagtgcagtggcgcgatctcagctcactgcaacctccgcctcctgagttcaagtggttctcccgcctcagccaccctagtagctgggactacaagcacgcatcaatacgcccagctaatttttgtatttttagtagagacggggtttcaccatgttggccaggatggtctcgatctctcgaccttgtgatccacccgccttggcctcccaaagtgctgggattacaggtgtgagccactacgcccagcagaaatacttcattttttaaagtaagtttaagattgcacgtcataagtagtgaaactgagatttaaacttgggtactctaacggctgagccttactatatcgtatattgcctctctgcaattgacatatatataacataatatgtttgtatacatacatacacagaggcatatattacacatatgtataaacatatgtcaaacttggcacttagtatactgtgtagcacatggaaaccatgtaaaaatggcagctattattactatattaatacttttttatcctttgtaatcatgtttatgtatgtaacatgtatattcttcttagacctacatcttatatattcttctaatactcaaatgctcgtaagaatatgacaacaacagaacaatggtgaagttgagcgctcaactggctctctagatcctatataacttcaggatgacttatcgaaactgtgaagggtaaactaagtattcgttcatttattcagcagtatttattgagaatctatcatgtcccgaaagctggggattctataataaaccaagataaacaaagtgccaccctagtggagtatatattttagagcagcactgtccaagaggaaaataaagcaagccatacgtgtaattatagcttttgcagtagtagtagccgcacttaaaaagtaaaaggagcccattatgtagagttagataacacacacagagtctgtaaggcaattggatataaaggaaaccttatataatgttacataaagtatcatatcacttctgagcagcagtcaactcacctttggaccttgtactccaattcccactggtcctcgagggcctgtaggtcccatttggcctacttctccctagtaagaaaagagtttaatacagcagcaaagtgaaaataatatattcctgctgttgatctcctaaaacctgtcttatatcaacaaagtaaaacagtttcatgtgctcaattcatatatattgcctgaaatcccttcgggggatggatttgcaccagatttggaatatatatgtaaatgaaaaatgtacataatgtttgatgtatatatggtctgacttaaaatataggccacatagcatattcaaaattgattttaaggagccccttgtggagggtatctggaaaagataggcagttgcattctagaacaactaaaattggcacaggaaaagccaaggtaactgctgatcaagagcaatgtcataagcagagaacgcaactcaagctttcaaggcaggccccaaatcaaaactctcaagaatagtcagagtggtccattgagcagcttctcacacggacagctctagggagtgtgttctaaggtgaatagtctcagagaagtattttatttatttaacaatgattcatgattcttagaagcaatattaaggataactagttaaataagtgccatgctcctcctcaaggaaaaaataatagttccaatctatgagatagtttgattcccaagtaaataaaacatttttatttgttaggtcatttctgaccccatctctttagctaaggttttagtagttgcacctactgtcagagtggtggtgagaatgaaaattagccaacctagagagacacataaccactggttgcctctattaatattactgtttgagttggtagaataggatctcataaataaaagtaacaaagaaaacaacaaatgaaaattgtgtaaataaagctttcttaaagcataaagaatacatattacattttctaaattgtcaggaatatcagtaacattttgcattaagtagagatctctgatttttaagttcattctacctgctgtcttcccttgcactggcactgatcagaaaacagcaattatactatagatatattaaactccgctctcatttacaaagttaccttggaaccaggtaagccctgtcctgcgggcccttgtggaccaggtggaccaataggaccttggattccctttaaaataaaattttataaaatagtgttagtgaaatgaagtagtttcaaatcctctaaagtgaaactttagttcataccccataataagttacttacactcaataagcatttgtggagtggggtgccaggggctgctagttaaaccacaatttgcattcttccctatttccatattaatagaaattttagctggcccgtatatctgcctagaataaagaccacgtttctcagtccctgttgcagccaggcgtggccatgtgggctagattctagccaatgggataggaatgaagtgatgtgtgtaactcctggttcatgctaaaagaagaggtatgccttctccttcccttttcctcttcttcagtagctggaattaagagagggtggccatccaggatcatgcagatgaggaaagcaccctcagtatggcagactatcaagaccgattaatagaggcagtagtcagttgattaacagaagcaatagtcagtagataccaaactgaagaaggttcaaacacttgactccctccttcacaatataaaggaggtttttatacatgggtataaaaaaggatatgcacatatgtgtacatttgtatatgtggttgtttatttttcactctatttgtaaaagatctgagttgatcaagcctccaaatatttaacaaaaatctgtgggccatttaagagagattgtaaacatgttgctggaaacagaagttccctcataaacacatgagggaaaacattcatttttatgagagaaataggaagatctaacataacaagaattcaatggataaacacatcaaattaaagaacattgaataactgcatagacagaggttaaatttaagtagaatttatatcatttgtcttaaaaggtaaataaattcttttcttgctcagatcattttacaaatagagatctcatttccaatagagatcagctctgtaaggacacatctacctcgaaatttttttttctttacaaaaagaagaaaagggggtaagaaaatgaaagaagtccgagacttttgttttgttttttttcccaagctgaagaacaacaacctccaccaaggaacagcattaaaggcgacaggaagctgtaggtaggaggtccagaattcacaggccatctgaacagacttgtcttcgaacctcatatttagccccatagtggtcactcagcaccaggagcactgcaagacccaagatgtgacaacactgtccggccacttttgggataagtaagcccctgctaaaaccaacaaataaactaaaaggcttgagaatgtcggctggtataatcaaatgatgatatttgagtagcccaaatgtccagctcttaattattatctaaatatttatttatacatttatcttggcttcttctgtaccttaagattcctaatgtgttagactaggacctctgccaatggcaagggaatggaaaaaggagtcatatccaactttgctgttgtttggactagcaagaaaagtaataataataataaattagcagccaattagaaataaacccaaagtaaatctcaacaatgacaccggaattatctcattttttaaattcttcccttctcccactaccctagatacagaaactagatacagaaagcactattcattctttaagcaatagaataattcaaaccttactcataaatcttaatcaaacctgacctgccactttctaaccaggagatatttagcataaaactgaatttgtgggttgctttgattaataaggctgcgtaagtatatggcaaacaacaaagtatatggtaaacaaaagactacatggtaaacaacagtagagagtactgttatactatcttcacattatttagatttatcacaatacccagattttccaaaagttatcagaagattttggaaatggttctaatcacgaatgtagacattcttacagatctttcttttcttctcaccaagaggggccaggtgtcatttataaattatatctgtgttttgcttctattccagaagtttgccccttaaactaagtggttatctctgatcctggtccaagttttaactataatacttttttaaaaaatggatatgtggctagttagagtggttggtagggggataccactctactccattgggagagagtgggatttaattttcacaaagcttcaaggagaaaaaaatacacaaaccagcaggtgagtaaactattgttcccaaggggaactaaaaatattgcaccaaaacatttaccttgttaattaggttttaatgttaaaagtcacagcatcaagaaacacactacttattttttaagcctttggaagttctaaaaaataaaatcttctcatgaaaccatcttatccttccctatattcacttctggacttatactccactgcaattaactgtcaaatatactcatagatgtttgcaggactggccttcaatgaagaccaggattgggctggaatgttctgcactgaagggaaaggaagaatgcattaattacctgttccccttgactcccgattccagggatacccattggtccttggggtcccacaggtcctatatccccctgcacagaaaataagccaggaaatataacaataaaataaaatcttattatttcatactttgctaacctggaattgggctgtgttaaaatctatctttatactataaaaaaaattcaacatggaaaattataaaactttattttattcctttaaaagtttataattcaaattccccaaaatagtaaatgacatttttgctattcagtctaagttggtgagcatttgtataggcttatatttatcaatcattttctcacaaacaaaatttcctgaatagttgttatgacacaaacatttcctgctaagattgtaacagaaatatttaaaagtagaaaattcataggatataataaaaatagaatgagagataaattgaagaaaaatatttttaaattttctaaataccctttccctccaaatcttattgaaaatgcattttgaaaatgaagaaatgatctcaagtgaatgcagcaaaattaaacagccctattttcttcttccatgaaattgagaaaacaaaattaaagttaccagcaagaagaacataattcattctttctgtgtctttatacaggtgtttgttgagtgcccattataagccagaaagtgttccaaacactaggaaaacaacagtgaccaaaacagctcaaaatctctgtcctccattgagcttagattttagtaggggaaacaagatggtaaacaagacaggtagataaaataactagtatgttgaataataagtgtgaaggagaaaaattaatcagggaagagaagaggcagcgatgattttggttaagatgtccagagatgaagtcactgacgagagggaatgagccaggtagaaacccagaagaaaagcattccatgcagagaaacagccaaaacaaagatgatgcctgacatgttccagaaacagcaaggagacagtgcgggtggaaccatctccatgagggagagcggtagacaatgaagtcagagaattatggcagtggagtcaggtagaaggatcagtggggcctttgaggccactgtaaggacttggctatcctctgagtaagttaggaagccactggagggttttgagaagggaagtgagagatctgacttggtttttaaggccccatctggaagctgtatggagaacagactgaagggggtctgcatgagagatgatggggcacaaaccagaatgttgagagtggaggtggtggggagtgctcaaaacctggataatgttgaaggtagagtgatgggatttgctgaggactgaaaggactcttggcagaatagagttgtcattgactgagaagaaaaagcctgagagaaaagcaaggtttgaggtggagggtgatatcaggagttcagttttggacatgtttagtttgagatccctaaaatgaacatccaaatggagatatcaagtaggtgggagaggcctgggatgagaacataaatttgggagccctcagtatataaatgatattaaaggccataattgagtgaatttgccaagtaatagaaaaaagagatggtcccaggactgagccctttaagcactccaatcattagaggtcagagagatgaagaagtcacagcagtggagactgagaaggaagcagccagagagaccaagtgaagagagtgtttcaagaaggtgagggatccatctgtcaaatgctaccaacagggcaaattagttgatgacagagaattgaccgctggattgagtaacatggttaacatgctcattttaatggcagttgtatttagactacattagggccgcaaaacttttaaacagttggatagcagatactttgggcttgagggtcataatgatgtctctcgtaattgatcaatgctgctttggtagtacaaaagtagccatagataatatatagtgaacaagtatacctgtggtctcataacattttatttgtaaaaacaggcagccagctcaacagttggccaatgtttgagctaaataaatatgtttttatgaagaaaaatgtatcatttgctgggcgccgtggctcacgcctataatcccagcactttgggaggcagaggtgggcggatcccctgagatcgggagttcgagaccagcctgaccaacatggagaaaccccatttctactaaaaatacaaaattagctgggcatggtggcacatgcctgtaatcccagctactcaggaggctaaggcaggagaatcatttgaaccggggaggtgaatggtgcagtgagctgagatggtgccattgcactccagcctggacaacaagagtgaaactcttgtctcaaaaaaaaacaaaacaaaaaacaaacaaacaaaaaaaacaaacaaaaagaaaagaaaaatgtatcattagatcaaactttatataacattaaatatatagaacctgcactaggagatgccctggaatacactacttagtgctctatcaacctttgatctacataaatattacggaaggaaaacataatggaatccagttctggctcagagctggactattttgattcagaacttgatttcttatgcatcagatattgtgcttaatgctttacatcctttcatttatcctcacaacaacccctgtaaagtggccatccccatttttcagatgagtgtaagtaactcaccccaggtcacgcaactgttagacggcagaggtgacagtcaagtccaactcatagccactagccaaaacccaactcatagccactagtttgcaaatatttgttaaacacataagagagggtccctttttgtgcagtgttattgacatttaaatacctgtgccataagtacaactttgttttgtaccatttacatacatttgagaggccttatcagaggcgtgtttatattatcacttgaatcacaaacatcaagccctctgaatctagtgttatatgtaaaagaacaggaaaggaagaaaggaaaaagaagatggtattgagggaacagcagataaaagctttgctatgtaataatatcctgatacttcagagtgatttctttgcatgacctccaaatgtaaaaataacatgcaccatgtcccaacaccacctgaaaaagttaatttactgaactcataaaacaatggttctgttgtattcagttctcgctgctccaaaggaagaaagagcaactcatgtattttttggagtattttggagttgctgtacagccagagctaagagattgaacaaagaattgtattgcatctaaaattcctatcactcactatttatttctgctatttaaatacaaacagctagaagagataactaccagcaaataaaaataagtcattcaagattgaaacccagcacttgagataatcatgaatatcaattgttatcctaatataatatacaatataattatctgcttaaaggctgatatataaatgactccaaattgatatgagttctctgcttttttatacatttcttatatccttccccctctggcagcttcacttccaatgctctttatggctgtatcagcctctagtagctcctatcaccagctccattcccatttctaatctggtataatctgcagctgttttaaagaaaacaaatagccagtgagaaagagaaaagcaatccctaacaacgaggagctgacctgaccctggcaagtaggccgtggtgtcaaacatgaacaatttgacaaatcatcaagatcaaacaaggccaccccatgactgtgatggaccaagatgaaagccagactactccataattatatctgagcacagacaaaaacagcaaacactatataaaaccctcaaattatcaaacatcctccaatactggctaaaatgagtgactgctacttctatcagttatgactcagcctaactccatttgtcccaacttctagatgagattcattaaatactcaatcctaaacttatccccaactattgacaacattaaatccagagcccatccctgatttcttaaatgcttcccaaaatcacctaacacaagtgcaaatcctatgaaatatctttcatcctcttcctgagtcactgtaggttcatcgtatgtggtcttccttccttcagagtcaacaagccttgctaaaactctggatggattcctgttggtccttgctggagggcatcaacactagttttcttaaatgagttttctgattttaacctgattttaagataatatttttgagtgggagcctagggatggatatacacttctataagaaggtcaagtcaatgttttttgttgtttttttttttagagatggagtcttgctctgtcacccaggctggagtgcagtggtgcaatcttggctcactgcaagctccgcctcctgggttcacccaccattctcctgcctcagcctcccgagtagctgggactacaggcgcctgccaccacgcccggctaatttttgtattgttagtagagacaaggtttcaccgtgttagccaggatggtctcgatctcctgacctcgtgatccgcccgcctcagcctcccaaagtgctgggattacaggcgtaagccactgcgcccggccaagtcaatgtttttaacaactgttttctttactaagaagaaatgtctttcgataatgtctggattcaaagctgctttgctgatggtagaagtcactggatgtcagaacccaaataagtgagacattacaataaatagaaataacctaatttctcagatcataactcatcctacataataacacaccttgcatatactagatttggagatcatcgtggacaggaggcaggactagatcgcagctcccactcggatggaaagaacagcatgtggaggctagcactgtgaacctttgctctagaacgactgcaggaatacatttggaaagccaagaaaacccacggacttgctgaagggaatggattgctcctgcaggacctgggagacatcccaaatattgtgagtgcccaaactatagaaatgggaaagggagattgtccgcccctgaacacatacccccactggggaacctgaaggtctagattatgggagctgagtcaatttagagagccaagcgaaatacaggagtagagaaagcagcaggaaaatccctgtgggctcagtgggttccctagcaagccatctctgcctcacatcactggggtccttgaggatggctgccagaggcactgggaaaagcccacagggggaaggaaacctccaactgaattctgtaataatttcaacagattgagaagtctcctggccagaactcaggaaagggcgtgaatccagtgtgcagactccacagacaggggaagaaggaaagctctactgactttcctagctgggaggtgggaagcctggggcaacctctcagccctactcacccactgcctggaaacagactcagtgttgttgggagggcacggtgggagtcagaccagcccttcagtttgcactggagctaggttaggactatgactgctggctttcccccacttccctgacaacctgtatggcacagcagaggcagccattatcctcctaggtatacaattccattgatctgggaacctctcccttacccccacagcagccacagcaagacccacccaagtagaagtagagtctgagctcagaaacacctagccttgctcccgcctaatggtccttccctatccaccctggtaactgaagacaaagggcatatactcatgggagttataaggccctgtccaccacctgttccttcccatactaccacaactgatgctctcttgaaaacaccacctcccaggaggaggccaaccggcacaaaaatactgtactaaccaaccaaagctaaggaccctcacagagtccatttcacccactggagcaggcgctggtatccatggctgagggacccacagacggttcacatcataggactctgtgcaaacagcccccagtaccagcctggagcccggtagacttgctggatggctagatccagaagagagataacaatcactacagcttagctgtcaggaagccacatccctagaaaaaggatgagactactaaatcaaggaaacaccccatgggacaaaaggaatttaatgacagccttgagccctggaacttccctctgacagggcctacccaaatgagaaggaaacagaaaaccaactctggtaatatgacgaaacaaggttgtttaacacccccaaaaaattacactagctcaccagcaatagatccaaacaagaagacatccttgatctacctgaaaaagaattcagaaggtgagttattaagctaatcaggaaggcaccagagaaaggtgaagcccaatgtaaggaaatttaaaaaatgatacaagaagtgaagggagaaatattcaatgaaatagatagcataaataaaaacaatcaaaacttcaggaaacatggacacacttacagaaatgcaggctgagcacggtggctcacacctgtaatcccaacactttgggaggccgaggcagatggactacctgaggtcaggagttcacgaccagcctgaccaacatagagaaaccccgtctctactaaaaatacaaaaattagccgggcgtggtggcacatgcctgtaatcccagctactggggatgctgtggcaggataatcacttgaacccgggaggcagaagttgtggtgagagctaagatcacgccattgcactccagcctgggcaacaagagcaaaactccatctcaaaaaaaaaaaaaagaaaaaagaaagaaatgcaaaatgctctggaagctctcagtaatacaatttaacaagcaaaaggaagaccttcagagctcaaagacaaggttttttaattaatccaaacaaaaaagaataagaaaatatgaacaaagcctccaagaaatctgggattatgttaaatggccaaacctaagaataattggtgttcctgaggaagaagagaaatctaaaagtttgaaaaatatatttggaggaataatcgaggaaaacttccccacccctgctagagaactagatatcaaaatacaagaagctcaaagaacacctgggagattcatcgcaaaaaagatcatcacccaggaacactgtcatcaggttatctgaagttaagaagaaggaaagaatcttaacagctgtgaggcaaaaacacctcactaatgtttaattgtaattctttaataacatattatatcgagcactaaatggaacttttaagttttataaagagtatctacaaaaaccctagagcagaagtaataataatgaactgttgaaatctttcctgtataggtaacctataaaggaaaacctatcagattaacagcagatttctcagcagaaactctacaagctagaagggattggggtcctatcatcagcctcctcaaacaaaacaattatcagctaagaagtttgtttccactgaaactaagcttcataaatgaaggaaagatacagtctttttcagacaaacaaatgctgagagaatttgccactaccaacccagcactacaagaactgccaaaaggagctctaaatcttgaaagaaatcctggaaacacatcaaaacagaaactctttaaatcataaatttcacaggacctataaaacaaaaatataataaaaaaggtatataggcaaaaaatagcacagtgaatggtacctcacatctcaatactaacattgaatgtaaatggcctaaatggttcacttaaaatacatagaattgcagaatggataagaattcaccaaccaatctgctgccttcaagagactcacctaacacataaggactcacttaaacttaaggtaagctgatggaaaatgacatttcatgcaaatggacaccaaaagcaaccaggggtagccattcttatatcagacaaaacaaactttaaagcaacaacagtttaaaaagataaagaaggtcattatataatgataaaaggccttgtccaacaggaaaacatcacagtcctaaatatatatgcacccaacactggagctccctaatttataaaacaattactaatatacctaagaaatgagacagacagcaacacaataatagtggggcacttcaatactgcactgacagcactagacaggtcatcgagacagaacgtcaacaaagaaataatggatttaaactataccctggaacaaacggacttaacagatacttacagaacattctacccaacaaccacaaaatatacattctattcaacagtgcatggtaccttctccaagataaaacatatcacaggcaacaaaacaagcctcaataagttcaagaaaagtgaaattataccaagcagtctttcagaccacagtggaataaaactggaaatcaactccaaaatgaaccttcaaagccatgcaaatacatggaaattaaataacctgctcctgaaagatcactgggtcaaaaatgaaatcaagatggaaatttaaaaattcttcaaactgaatgacaatagtgacacaacctatgaaaacctctgggatactgcaaaggcagtgctaagaggaaagttcatagccctaaacacctatatcaaaaagtctgaaagagcacaaacaaacaatttaaggtcacacctcaaggaactagagaaacaagaacaaaccaaacccaaactcagcagaaaggaaataagcaagatcagagcagaactgaatgaaattgaaaattagataaatgaaacaaaaactggttctttgaaaagataaattgatagaccatcagcaagattaaccaagaaaagaagggagaaaatccaaataagttcaattagaaacgaaacaggagatttacaactggcaccaaaaatctaaaagaaatccaagcagaaatccaaaagatcattcaaggctactatgaacacctttatgcgcataaactagaaagcctagaggagatgaataaattcttgaaaagatacaaccgggggaggagccaagatggccgaataggaacagctccggtctacagctcccagcgtgagcgacgcagaagacgggtgatttctgcatttccatctgaggtaccgggttcatcccactagggagtgccagacagtgggcgccggccagtgtgtgtgcgcaccgtgcgcgagccgaagcagggcgagcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccccacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgagaagctcgaactgggtggagcccactacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgactttgaagagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggttatcagcaatggaagatgaaatgaatgaaatgaagagagaagggaagtttagagaaaaaagaataaaaagaaatgagcaaagcctccaagaaatatgggactatgtgaaaagaccaaatctacgtctgattggtgtacctgaaagtgatgtggagaatggaaccaacttggaaaacactctgcaggatattatccaggagaacttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaaaaatctcactcaaagccgctcaactacatggaaactgaacaacctgctccggaatgactactgggtacataacgaaatgaaggcagaaataaagatgttctttgaaaccaacgagaacaaagacacaacattccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttagcaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgccgaaggtaatttacagattcaatgccatccccatcaagctaccaatgactttcttcacagaattggaaaaaactactttaaagttcatatggaaccaaaaaagagcccgcattgccaagtcaatcccaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggaatctaattaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactgtattaagaaaatgtggcacatatacaccatggaatactatgcagccataaaaaatgatgagttcatatcctttgtagggacatggatgaaattggaaaccatcattctcagtaaactatcgtaagaacaaaaaaccaaacaccgcatattctcactcataggtgggaattgaacaatgagatcacgtggacacaggaaggggaatatcacactctggggactgtggtggggtcgggggaggggggagggatagcactgggagatatacctaatgctagatgacgagttagtgggtgcagcgcaccagcatggcacatgtatacatatgtaactaacctgcacaatgtgcacatgtaccctaaaacttagagtataataaaaaaaaataattaaaaaaaaaaaaaaaaaaagaaaagatacaaccttcctagcttaaatcaggaagaattagatactcttaacagaccaataacaagcagtaagactgaaatggtaattttaaaattaccaacaaaaaatgtccaggactagacggattcacaacaaaattctaccagacattcaaagaattatcaatcctattgacactattccacaagatagagaaaaagggaaccctccctgaatcattctatgaagccagtatcatcctaataccaaaaccaggaaaggacataaccaaaagagaaaactacagaccaatatccctcatgaacatatatgctaaaatccttaacaaaatactagctaactgaatccaacaacgtatcaaaaagataatccaccatgatcaaatgggtttcataacagggatgcagggatgggtttaacatacgcaagtcaataaatgtgatacaccacatgaacagaataaaacaggctgggcatggtggctcacacctgtaatcccagcactttgggaggtcaaggcaggcagatcacttgaggtcagaagtttgagaccagcctggtcaacatgatgaaaccccatctctactaaaaacataaaaattagctggatgtggtggcgggcacctgcaatcccagctactcaggaggctgaggcaggagaattgcttcaacctgggaggtggaggttgcagtgaactgagatggcaccactgcactctggcctgggcaacaaagtgagaccctgcctcaaaaaaacaaaacaagaaacaaaaatcacatgatgatctcaatagatgcagaaagagcatttgacaaaatccagcatccctttatgattaaagctctcagcaaaattggcatacaaggagcatacctcaaggtaataacaaccatctatgacaaacccatagccaacataatactgaatggagaaaagctgaaagcattccctctgagaactggaacaagacaaggatgcccactctcaccacccctctgacacatagtactggaagtcctagccagagcaatcagataagagaaagaaataaagaacatccaaatcaataaatagaaagtcaaagtgcctgtttgctgatgatatgattgtttacctagaaaaccctaaagactcctccagaaagctcctagaattgataaaagaattcaacaaagtttccagatacaaaattaatatacacaaatcagtagctcttctatacaccaacagcaaacaagccgagaatcaaatcaagaactcaaccctttttacaatagctgcaaaaaaaaaaataaaatacttaggaatatacctaaccaaggaggcgaaggacctctacagggaaaactacaaaacactgctgaaagaaatcatagatgacacaaacaaatgcaaacacatcccatgctcatggataggtagaatcaatattgtgacaatgaccatactgccaaaagccatacacaaattcattgaaattcccatcagaataccatcatcattcttcacagaattagacaaaaacaattctgaaattcatatgcaaccaaaaaagagcccacatagccaaagcaagactaagcaaaaagaacaaatctggaggcatcaattacctgatttcaaactacactataaggccatagttaccaaaacagcatggtactggtataaaataggcacatagaccagtggaacagaataaagaacccagaaataaaccatcatacttacagccaactgatctttgacaaagcaaacaagaacatatagtggggaaaggacaccctattcaactggaataattcagctggaataattggcaagccatatgtagaagaataaaaccggatcctcatctctcaccttatacaaaatcagctcaagatggatcaagaacttaaatctaaaacctgaaactataaaaattctagaagataacattgaaaaaactcttctagacattggtttaggcaaggatttcatgatgaagcatccaaaagcaaatgcaataaaaacaaagataaatagctgggacttaattaaactaaaaagctttttcacagcaaaaggcacagcaaaaggaacggttagcagagtaaacagacaacccacagaatgggagaaaatcttcacaatctatacacctgacaaaggactaatatccagaatcttcaatgaactcaaacaaattatcaagaaaaaaacaaataatcccatcaaaaagtgggctaaggacatgaatacacaattctcgagaagatatacaaatggccaacaaacatgaaaaaatgctcaacatcactaacgatcagagaaatgcaaatcaaaaccacaatgtgataccaccttactcctgcaagaatggccataatcaagaaatcaaaaaataatagatgttggcacggatgcagtgaacagggaacacttctgccttgctggtgggaatgtaaactagtacaaccagtatggaaaacagtgtggagattccttacagaattaaaagtataactatcatttgatccagcaatcccactactgggtatctacccagaggaaaagtcgtcattatacgaaaaagatacttgcacatacctgtttatagcagcacaatttgcaaatgcaaaaacatggaaccaacccaaatgcccatcaatcaatgagtggataaagaaactatgatatatatattacagtgtgtgtgtttgtttatatatatagtgtgtgtttatatatagtgtgtgtttgtttacatatatagtgtgtgtgtttgtttatatatatgatggaatatatatactgtatactatatatacagtatatatagtgtgtatatagtgtatatatagtataacatatattatagtgtgtttttatatatatgatggaatactatatatatactatatactctatatatatatggaatatatatatatatatatgtgatggaatactactcagtcataaaaaggaatgaattaatggcatttgcagtgacctgaatgagattggagactatcattctaagtgaagtaactcagaaatagaaaacaaaacattgtatgttctcactcatatgtgggagctaagttatgaggacgcaaaggcataagaaagacacagaggactttgaggactcggggcaaaagggtgggaagagggtgagggataaaagaccacaaattgggttcagtgtatactgcttgggtgatgggtgcaccaaaatctcacaaatcaccactaaagaacttactcatgtaacctatcaccacctgttcccaaataacctgtggaaataaaataattattttaaaaaaagaatatactagatttataattaaccagatacctgtgtggcatggttgtcatgtatacagttcagaaatgtacatacataaagaacaatgacaattttattggcattgtttccagtgtacaccctattatacagtaccttctcccctttgattgacaggccttgtaatccctgtgggccagttggtccttcagaacctttttcaccctgaaagtacaagggagggatatcaatgcaccaaccaaaatctgaattttaaaagagtttacattacaaatactatgaattgtgcttcaaaattattttttaaataaagcatccaaagtcactgtttactacaaatgggtaattctaattgactctgagatttgcaacttgcaaaaaatacattagtcataacacttaaacaagaaggaagctatccaagcaaaacacatatgtagcatccctgaagttagaaaagagctcagttcccaatttaaacaaaaatattctggaaatggatcacctaatcaatcacatagtataactaactggatcaagtctccttttccttaatattgctgaaactgggtccatcacacaaggaaaatttatttctcgtactaatatgtgaactaatacttgctaggattagattattacctttttttttgtttataaacattcattgaaaatttatgtttaaaagaattcatggaaaatcttcttagatatgctcctacagttacatgacgtaagtgaacagctctgtccttaatataacgtatattgtcataatacttcatgcatttttatgaaaaataaaccatataataaatcagaagcagcattcatttaataaatttattagaaccaagagtaaaatcaaagaacatttacaaattagccccaaatagtacatacagagaacacccattggtctgactagttggggaatgaaatattctgattctgggttcttctgatcattaccacagaatataactgcatatacttgatcctaaagcagcacggaacacgatgtgttctttctttgatgagatagaggtcaatgcccatgagctattacatacaagagtatcaataaagtatgataatacctcatataatataaaagtatgttgaacctgtcactatgaaataccctggaatattcttcttaatgtttcacatattcatttctcatttatttctttctctttaaaaaacacagattttaaagagaaataattctatttgaatttttcagattatttgggctacacataaatagaagtagaaatttactaagtgccaaaaaaatctcaaactgtgtattacaaaactttcggtgatgtcatgccaagttgctgacctgtcttctgatagtgatactgtgattagtcaaaggtgttagtaatatccctttatccaacatattatttccattatcatgacaaattaaaatgtgttcattaacaagggcgtcttttaaaatttaacccagcagtcactcaaaactaaggatgaattatttgtttttatctaattgttttccctctagtagagatttaggattctcatagataattgaatatcgatcatggtggaagaagctgagaatgaaatgcacttttagagcatgaggccatactgagaaggccatatcttagtcacctgatggaatgactgatgtggagggtctcagacacttagaaagcagcatgtacttctccgggcagtatgtgtgtatatgcatgtgtgtgttttttggggagactttggaaataaaggaagaaggactccaaaatgtatctttacgtactctgaaatgttgttgatgctgctcattttggaaaacactttttaacatgcccttcagcaaatgtgccaaagattatatacaaactgcctatatcaggggacagcaaactacagcccataagccaaattcagcccactgcctgtttttatattataaatatagttttattggaacagccacattccttcatttatacattgtttatggctgctttcaagctacatcagcagttaagtagttacagcagataccatatggctcacaaagcctaaaatatttgctatctgcccctttacagaaaaagtttgccaacctttggtgcagaacaacttgagctccaagaattacataagggaaatgacaggaaattctcaatggctagttaaaaaggaagtctttcataacattttgtttctgtagtaaaattttctttcttattatattgatggcagtactattacagattggtttcttatctgtgtttcacgaaaaaagctgtgagcaaagaattgccatagctacactcgatgatttaacttctgggcataaggatgttatttatcactgtggctttaaatgactacaaactactttaagagatttttctaatttcatatgtagtaattacatgaagtagaagtctttcaattacttatttgtagttccaaattttactgtattttcgcattacagggaaatttacatattccttcattaaatggaataaagatggtcagaaaaataattaacttctaaaaattggctaggacacatttttaaaatttgtaattcacgagcatgtaagacaaagcaccttttcctggtacagaaggtattgttacctttggtcctggaaatccttctccgggtaagcccctctctcctggtactccctcaggaccacggggaccctggttaggataggagaaaatgaggagcaggaggagagagaaaagggaaagaggagtgatgaaaaagaggaaagaggaagaaagagaatggttatatttcagtttacatgccaaaaaaaaatggatagttggatctgtactaaacatgtacaggctttttctactttattagttcctaaatactatagcataataactatttacacagcatttacattgtattaggtattgtaactaatctagagatgattcaaagtataccagatgtgcataggttatacgcaaatactatgccattgtgtctggaattggtgggttcttggtctcactgacttcaagaatgaagccgcggaccctcgcggtgagtgtcacagttctaaaaggcagcgcgtccagagtttgttccttctgatgttcagttgtgttcccagtttcttctttctggtgggttagtggtctcgctggcttcaggagtgaagctgcagaccttcgcagtgaatgttacagctcatataggcagtgtggacccaaacagttaacagcagtaagatatacagcaaacagcaaaagaacaaagcttccacggtatggaaacggaccccagcaggttgcctctgctggctagggcagcctgcttttattctattatctggccccacccacttcctgctgattggtccattttacagagagccgattggtctgttttgcagagagctgattggtccgttttgacagggtgctgattggtgcgtttacaatccctgagctagacaccaaagttcttcacctcccagctagattagctagatacagagtgtcgattggtatatttacaaaccctgagctagacagagtgctgattggcgcatttacaaaccctgagctagacacagagtgccgattggtgcattcacaatcccttagctagacataaagattctccaagtctccaccacattaactagatacagagtgccgactggtgcattcacaaaccctgagctagacacagagtgctgattggtgtgtttacaaaccttgagctagatacagagtgctgattggtgtattcaaaatcccttagctagacataaagatgctccaagtccccaccagattaactagatacagagtgctgattggtgcattcacaaaccctgagctagacacagggtgctgattggtgtgtttacaaaccttgagctagatacagagtgctgattggtgtatttacaatcccttagccggacataaaggttctccaagtccccactagacccaggagcctagctggcttcacccagtggatctcgcatgggctcgcaggtggagctgcctgccagtcccaggccctgcgcccacactcctcagcccttgggcagttgatggcaccaggcgctgtggagcaggggccgtgctccttggggaggctcaggccacacaggagcccacggcgggttggggagactcaggcatggcagtctgcaggtcccaagccctgccccgcggagaggcagctaaggccaagtgagaaatcgagcgcactgccggtgggccagcactgctgggggacccagtgcaccctccgcagctgctggcgcgggtgctaagcctctcactgcccggggcggcagggccagtcggctgctccaagtgcggggcccgccaagcccatgcccacccggaattctagctggcctgcaagcgccaggcagccctggttccacccgtgcctctccctccacacctccccgcaggctgagggagccggctcagccctcggccatcccaggaaggggctcccacagtgcagcggtgggctgaagggctcctcaagcatggccagagtgggcaccgaggctgaggaggcgccaagagcaagtgagggctgcgagggctgccagcacgctgtcacctctcaccattttatacaagggacttgagcatctgtggattttggtgtctacagaggtccttaaaccaatcccccatgaataccaaggaatggctaatgactgtggctctgtttaaatttttagtgagaatccttctagtcaactcaatactgatcagtagaattgtagagctacgaagaataatactcccattgtattaaatactcgttccatttgattggcataaaatgttctattccactgttctcaaagtagaagaaaatggaaattaaatgatgctttgaaataagaattaagaaataaattatctgaggaaatgctaaaaatctggaactgtgtggcccagagaaggatgcagagtgatttaataatttaattatcaggggagtgctgtgaagaaatcatcacacagctgttttaaagcattaagtgctgtttacatgtgtttcaatttctgtactgataaatttggattaaaacttgaattatttcaggaactggttgaacccacaggcagttttatatgcaaattgaaatcttgataggatcattaaggggaaacatgattttcaattgcaatgattcaaattaagaagttcatgtaactattgctcaaaaagccactaggaaagatgacttctcacatgagttaagaaaaacacagtctcgggctttgaaatggacttgcagaaaatgtactaatggaaaaataaaagagtaatagtgaggttttcatttaaatcaggaatttttaaagacaataatttttctctccttttcttcttggccagaaggtaaaaaagtagtaaaggaacttacaacaagaatcttagaagaagaaaatgaagcttttcctctgatgaatctaaacaaataattaggcttcacttgccagagaaataaacctatgatggaacaaagtctgccaactttcctgcaagttcctaaaccagcacactacagacactgaatgatgtttgggcttgagatacagtaatccagggtgatttaagacgcttttctcctcaagcccagtagcagaacgaggatgcagcattatactcatcagtgactgatcatagttatagattcataagaaaaagatctgtttttcagtgtttaatttttttgtctttccctaatgttttatattttacaagacaatcttctttagtatttatgcatactgattttgtaaataattaaaagaaaaagctaacatctttttcaatttaaattgtaacacttaacagaaacctagcttttaacacttccaagaccttaatgaaagcactaatatccatgacagtttattgtacgggcagagcaattagctagtaggaaaataaataggagcatgaaaattattaatagattgcaaactcaaccaaattattaatagattgcaaactaaaccaaaagtgccaagccaacatcacatactttaacaaagaaaacacatactttaacaaagaaaacactgacaaattattttttccctaataatatgacaaatgaaaaaaaacacaatttatattaaatgtaaggaagtatttttccagttcactcaacttttttcattcatccaacaaagatataccaaacttctagcaggtaaacggcattgtgctaggttctagggatagcagacaaaactgctccctgtctcatggagctgacaatattgcataatagttaaaagcagattttggtgtcatttgtactgaggttcaagccccagctctgctacatagtagcagtttcaccttaaacaagtaagtcaatctctgcaaagcacaacatcctcctcaaaatggttgataataatagtatctacctcaaccacaagtgttcatgtaaggattaagtcagagagatttaaatcttttacagattaagcactcaataaatatctgccatcattatccaaattattttacttgagtcctgtaattgctaagaatgtcctttcatggaagtttttacaaataaaagcagtctctgagtgaatgatttaaattaaacaatgtgtaaaaagcatgctgcactgaataaacactgaatcttccttcattctctgcacttctagagtacgttagctaaactggaggtgaaaatattggatctttaaggagccaagtattcaaagctgctgagaacggagagttaatgctcatggacagtcttttaggagaaaaaagcagtgatccaaagtgtaattactataaaccatcagagtagtattccacgccatcagtatattctcaagtcttccagttaaacactcagcatggacgatgatcattagccagagaagagaagtagaaggtacttgggttaaatggttatagtttaatttattaagatagtaccaaaagattatttttaaaagacagaaatccttctattaaaaaatctcagtgtcctttctaaggccatgagaaccaattacaactacgacatacttacttggcttctaacgaacacctctaataaaaaataaataatgaaggaatctaattatcagttaacacagcctgatcagtgaaatgctttatctgagacattaacgatgagatgaaatacgattgtccattatgttcatcttattactttccgtagtaatctcaatagtgttaataatcaatacaaatgctttcaatatgcattgcaagcattagagataaatatgctaataataatagtaactgtccattatcttcaaacagtgccatctactttattttttaatctcaaaataattatagttccctttcagggttttttttttaatttacagtgctctgaataaccttgcataaaaaacaaacagatcaccctgacagtcttaaccaatttaatttttatgaatcagttacatctaccagaccagcacaaaactagtggtaatcacataaagatgacagatgacagttcaaaagtaggtctcggagctagaatattaattcaatctatcagcagatttatattagtgtggtagtgaaaagagagtagtactaaatacgaaacacttgaaataattcaggcaaagaaacaaaagcaaaggactttcagtagaatctttgtcagccctaagataagtctttaccttacttctaaataattcaaaaattcacattgttggctgagcatggtggctcaggcctgtaatcccagcacttcaggacgctgaggtgggcggattacctgaggtcaggagttcgagatcagcctggccaacatggtgaaaacccatctctattaaaaatacaaaaattagccaggtctggtggctggagcctacagtcccaactacttgggagggtgaggcaggagaatcgcttgaagccgggaggtggaggttgcaatgagccaagatcgcccaattgtgctccagcctgggggacaagagtgagactctgtctcagaaaaaaaaaaaaaaaattcacatcattgatttttttataatgacattttggtgcaacattttgatacattatttaggaactttcctacctttgttatgattttagttcccaattaagtataactctgtaattatgacttggaaagcaagcaagcaagcaagaatttcatgttctggtaatattgttaaaaactctcaactacaaacagttagaaagacaggtaatatacgttttttaagatgaattttaaaggcatggaagagtccaaagaagataagagaaattgcagggttcaaaaagagagaatcaaaactcgagaactctagcatataagttaagcatcttaggtaagcatctaagctggtgctacagctgtcctgaatagaaaagtgtgtttgtgtggtgggaagaaggctaggaaatttagagggaggaacagcagcaaagactttggctcacgcaatggaaaatgaagacagaattataactgagagactgagattcccacaaacttagacagacagtctccaacttaagatgggatggttcgacttaagatttttggattttacaatgggttggtcagcatgtaaccccatggtaagtcaagtacctccttatgacttacaatgggcttatggtttctactgaatgcattgcgtttgcatcctcataaagtaaaaatatatatataaatcaaaccattgtaagttgggaaccatcttcggtgttaccaacactaaatgcattttcaacttacagtattttttatttatgacgggtatagtaggatgtaactccattgtatgtcaaggagcatctgtatatattcaatgaaagaacaaagtagaaaaaagccatcccatcaacacagtggtatgaatgacaagaatcttgtctgcttggcttgggctcataatgactaaaaatttctaccatggtcctgtgctgtgtatgagtttatgatttcaattgacattatctaagtggttcatgaacaccttagtcaagacattagcatcaaggaaacccctggagtacaaaagagatacaaacacaaactcctctcaaatcctaagaatgcttaggattcacaattaaagcccagctgaaaataactcagatggaaaagtacaaaacataaaagaaaataactcacaatgaataaaagtaaactaacacaacgtaaacttcctcaagaatgtcaaataatagaataaaataatagagacaaaaaagaagtactttaaatacttaatggtcttatggaaataatggaaaatacaagaacagtatagtaaaaagataataaatatagttaataaaaggcagattttaaaaaataactaagaatttttaaaatacttattaacttaaaaatacaatgaatgagttaagaacattttataacatgatgaagataaatttgtgggttataagttagatttgagaaaattatccaattgcaaccaaatatctagtaggatttcttgataaatagaatggggcaagaaaatatttgaagaaataatagctaagaacttttttaaactatggagtcctcagattcatgaaacggtaaatctgaaaaagtatatgtgaaaatatactcacatttatatgcatcataattcctctacaggaaatctaaagaataaaaaaaaattgcaaaagcagcctaaagcaaaaatgaattactacaagaaattataaacagactaaagacatggaaacagaaaccatggttgccagcagacaatggaattagtacacaatccagactgcaccagctaaactattcttacaaagcaaactaaacaatggcatttcaaccaaaggctgaaagggtttactgctaacatatttttactgaaaacatcttctgaaagaagtatttattgaaaaaaacaaagaaatcagccaagaagaaaagagaaatttaggaagctatgtcaactaagaaatgggtaaatatatgggtaaaactatacaaatactgacttaaaaaagttcaaaaataataataaataattttggtaggatgaaaataaagtagaactaagtcaataggaatgatactctgaaggtggaagaaatgattgaagtaaaagtgtcatatggtcagtatatttttcaggagtaggtggcaatattgatgacatttcaaacttgttagtcaagaaaacatgttaggaatcaacctaaatgcccatcaatagtagactggataaagaaaatatggtatatatacaccatgaaatattgcacagccataagaaagaatgagatcatgtcctttgcagcaacatggatggagctagaagcgcttatccttggcaaactaactcagaaatccaaatactgcatgttcttacctataagtgggagctaaatactgagaacacaaggacacaaagaagggaacagcagacactggggcccacttgaaggtggagggtgagaaaagggtgaggatggataaattgcctatcaggtactatgcttcttatttggatgatgaaataatctctacaccaaacccctgtgacatgcaatttacctatataacaaacctgcaaatgtacccctgaacctcaaataaaagttaataaaaagaacacatattaaagtttagtaaccacaaaaaaagaaacaaaatatgtaaaaatatatacaagtatatgtacacatatatagatatatacataccaagttgtgcatgtgtgtgtatatatgcttgagatatgtatatatatttgatattttgcccaatttctaattcgatttttattattgagttttgagaattttttttaaaaatgtattcccaatacaaatcctttgtaaatgtgtagtttgtgaatattttctcccaatcagcagcttgtctctttatacccttaacagagtctttcacagagcacacatttaccactttgatgaagtccagttaattactttttagggggggatcatgtttttggtgacatgtctaagaaatcttcatcaagcccacgatcctaaagattttctcatatgttttattctaaaagttttatagtttttacattttatatttaaatctatgatccattttgagttactttttgtataaggtgtgagacttaaattgaggttaattttttgtgtttgcacagataaccaattgcgccagcaccatttgttaaaaagactatgtttcctctattggattgctttcacaatctgttgactatacttgtgtaggtctgaatctggggtctctattctgttccactgatcatatttctataatttgccaataccacacagtcattgttactgtacctatataataaatcttaagaccagaaaagttagtataatttctccaagtgtattctttttcaagttttttaaaagctattctagctcttttgcctttccatattaattttaaaatagccctgtccaagtctaaacaaaatcttgctggggtatcaaaaacatttgcactaaacttttacatcaatttgggaagaatttacatctttatgttgttgagtcttctaatctgtaaacatgcctctaaatgtattaagtattctctgatttctttcatcagtgttttgtagttttatacaagccctatatgtgtcttattagatttctacccaagtattttcttttttagcaattaaaaatggtgttgtgcttttaattttagtttctatgtgttcattactagtatacagaaattaaatagattttgtatgttgatattgtaccctgtgaccttgctgaactcacttgttaattctaggaggtttttgtatagatttcttggggttttctatggaggccatcatatcatctgcaaataaggatagttttatttattgtttttataccaatgccttatatttctttttcttgtcttatcgtgctggctggaacttccaatatgttgaataagactgatgagagcagacatctttgtcttgttcctgatcttagagggatgcattcactctttcactattacgcataatgttagctctagatttctcatagaaattgaggaagttcctcctctatttatagctttctgagagtttctatgagagatttatcagcgtttattagggttttgagttttgccaaatgctttcctgtgtcttttgatgtgatcatgtgatctttcttctttagcctattaatatggtgtattccattgattaattttcaattattaagccaggcttgcatccacaggataaaccccacttagtcatgctgtataattctttttatatattgctgaattctattagctagcatgttgttaagaatttttatgtctatattcacaagggatattggtctgtagttttcttcttatgtatgtttagtattttgttttggtatcaggggaaaactggcctcataaattaagttgataaacgtttcttcctcttctattgtctgaaaaagatagggagactttactgtatccataatgttttatgttttttaaagaaaatctaaagcaagagtagtaaatgtactaagtataattgtctacctggcggaggtttaccaactcattctctatattttccaatatgcttaaaatatttcattatttaaaaaaaaacattttaagaacgacaatgaataagtgacactcattcttaagtttagtgctgagtttggaaggtataaataatagcaaagcacaaagttctttggaaaaaacaatcatcaatctatatttaaaaattttttacgcggggcacagtggctcacgcttgtaatcccattactttgggaggcagaggtgggttcatcacctgaggtcaggagttcgagaccagcctggccaatatggtgaaaccctgtctctacaaaaactacaaaaattagccaggcatggtggcgggcacctgtaatcccagctactcgggaggctgaggcaggagaatcatgtgaacctgggaggcagaggctgcagtgagccgagatcatgcctctgccctccagcctgggcgacagagcaagactctcttaaaaaaaattaattatgacttatttctttgacattttcagaatatttccagctctgaaaatcatagacctaaggagaacccaatcttttaattttatagaagttaaaatttgagacttcgctaaattaaatacatccacaagttctttgatattcttcataagcgggcaaaatctttttctattccactcgaatctgagctggtcctatacttactttagatgtcacagaaatgatgctgtataatttctgaggctaagctttacatgatgagtggtttctgcctattggaacactcctgcttggattcaagctgccatgttgtgaggaagcccaagcaaccactgtagctgcccatgtggaggagaaatgaggtctctgggcaacaaccctagctaagctcccagacaacaacctgcaccaaactgccagccatgtgaggccatttttaacattgcagccattttagcactccatctgacttcaagttataaagaactctcatgtcaacccgcaaaatcataaggaataacaaattattgttttaaggcacttagtcctgaggaagtttgttaagcagaaacacaaaaccaaaatagagaccaaaataagttagtggtttatctttaatggtactatctatttagtggaaactaagactagatcactgatctctagatgattagtccagtgtatttttcttccatataatgctctcttttttgaattagtatgttcagacattagtgaaaagcctaaacctaaataatatgttgccatttcactcacagagtgcagtaaggaagtgtatgtttctgtgaatatacacatgtgaggaactatgcagtgcaaagacaacttcaaagaccagctatccacaatcagttgtttttatttgtacctaagtgagtcagctactatttttccctaggagaataatgattacttgaaaagttaacaagctttatataccagaataatcatattttattcacttcctctccaaatgtcttttagtagaaatttttttcttctccaacaacagtaaacttcaaaactacataaaagagatgctgtgaataacgcaggtattatctgtctaccattatcaatcctagctttagagcatactcatggattagataatgagccaagtccttattctcagtgatttttctcatggttacaaagaaatccattataaagtataaacattaggcttgagtccagatcttcctagaaaattttaacacatgagaactcttttcttcttgttcaagttgattcatcttgtaagaagttacagtaaaagagagttggtgtaaacatcatatatatttacacatatacatatatacatagttctatttcaagtgttgtgaaaaatagcacgtggatctggttctcgcatatttattttcatttgttgctcgtaaagatgcaaggtggttgggaggctgaggtgggtgaatcacctcagctcaggagttcgagatgagcctggccaacatggcaaaacaccgtctctactaaaaatacaaaaaacattagctgggcctggtgacgtgcacttgtagtcccagctaattagaggctgaggcaggagaatcacttgcacccaggaggtggtggttgcagtgagccgagatcatgccactgcattccagcctgggtgacagtgagattccgtctcaaaaaaataaataaataaaatagatacaaggtggattaatctgaccatttatcctaaacagaaagaacaagtaaaaactatatttgtccttttcattccatctagaatttttgctacttactggctgtccaggctcaccaactccaatgggtcctggagctcccggtcttccttcttggcctctttctccctaagagaaagaaataatagaatgaaagcttgagattttaaataaagaataaacatagcgcaaagttctctcaagatttcaacaaggataaatagcgaaatagacaaaatgttggttttcataaaggtaaaaaattctagaggaagagaaatagctcgaatttaagtgaacaaattaccctaaaatgtttattatctcttcttgtccaaatgtaattcagtattttcagttttcacaaaatattgtgtaagaattggcaggacagactgtgtggcaatgcaggttggttacagagctgactaagctgacaatgtgtgtgctgtgccctgccctcttgccaccatccaggaatgtcaccccttccttgtccccactctatcctattcatctctcctttaagctcttttcagacttcatctcctccagaaaacttctccataactctgccagcataaactccacctttcctggagtctcaatgtgctcattgttgaaatgctatacatggggatattcaattacattcaaagtacactgttttgtactgcttgctattttaatcctgcatcaaagtcttattgtcacaaccacttggaaaagccattcaaaataggcacttctgctttattaatatgtcctgcataatgtacagcctcacaggatggacgttccttccttccctttctagttctctacaaatctctctgccaacattgacctattcattgccatggcccttctggtttctgcccctttatgcttattcaatgtgaaccatgattgttgatgtgttaagttgtttcacttcccaataacatatttgcatgtgaatgtttaaagtccatgaaaacaacagaactacatgtaccttggcaaaagggtgggtatttggagacaagtaagtttttcattccaacaaaattaaaaaatacgttaattattcttgtggtaactgcccctgacaagcacatttctgtgtccaagcacataaaatgaagtaacttcaggaagcctccttgtgtctattggatttaggccaaatggagttcaaatcatggctcccccaggccctacaataaattcaacagtcatcagtgggcaaaaagacaagtatctttaccttaataccttgctgtccaattccaggagctcctggagaaccataaggaccaggaggacctggctcaccctggaggaagaaatagtgacatcagttatatgttaggtcgactcaatagtattgactaagcagcttttagatgtatggttttgcaataggggctttcagagcaacaacaaacctgtacatcgtgcctgccctcaattgtttacaactcatttggaaagaaaacacagacccaagatcaaattatccactaggcacagtagtcacaatatctgggtccacaacactttcaggagcctgcaaatatgttccaattgtaattttttgattcaaaataaaaataaacataatgactatataacaatgaatacagcttgcattcataaatataattttttaatgtgtttatggaggaaggggcccacaaagtcaagtgttttcaggatccataaaaggcataacgcagccatcactcattcattcacaaatctttaagtgctctggaagacatattttgtttcctcccctgcggctgtcctttctcagctttccttccctgctgataaacccccaattgagtcagtcagtgggcagctgttctttgccctcagaggtgtaggatgaatgatcattggcctaatgcaagatgggaatctcctttccctttgtcactgattcatctcagttggtcacatggctcaattctgacaaacgagatgtgaaggaccttactggatgcaaaggagaaaactgcctctgtctcttctttcctacatagagatgtgataactgtcttgtaactatgaggcagcaatctctaggacaaaagccagctgctgaagaggcctggctcctggataccctcaatgagcaactgatccagtcctggactacctgccttcaaatattctgtttactcaacagcaagagttctcatgatttaagccactattattcaagatttctgttactcaaagccagagcattttgaaataataatagcctatgatgtggcaagcccataatagaattcaggcattttagaactagatgtgaccattgcactcaaacccctacatttcacaggtgagaaacccaagtcccagagagattacctggccagcccaaactcacacctgaataccactcacacagttacagctctttaggtctctccggctttaagccctgtggcatgatgataggggaaggggagtggctattgaccccaattacccatttcataatattatttttttctgtttatcaaaataatatgtctcattgtagaaaattgtcatatattaaaaagcatgcatgcaaagaaaattttaaattacctatctgtaactattaatactataaaatttcggtgtatttccttccagttttttacattcacacgtgtacctttaatttatgctaaggaagattgctgaacactctttatgtttcagctaatgaatatttgctattaaaaatttcattcaacccaaaggtttctctcttcatgctttcactaaccaacagtaaaatgaaacaggaaagtgaaacaagccttctctgagatgaagggagataaaggagttttcagaaatattaaagtctcaatttaccccagaagcttgtgattttggaagggacacctaatgaccagagcaatgttctgtggatatagtaaagacattgctttactataagaagtctgtaaccgatgtggtggctcatgcctgtaatcccagcactttgggaggccgaggcaggtgaatcacttgaggtcaggagttcaagaccagcctggccaacatggtgaaacactgtctactaaaaatactaaaaaaaaaaaaaaaaattagctgggcctggtggcatgtgcctatagtcccagctactcgggaggctgaggcaggagaattgcttgaacctgggaggtagaggttgcagtgagccaaggtcacgccaccacactccagctttggcaacagagtgagactccgtctgttaaaaaaaaaaaaaaaaaaaaaaaaaggtctgttgactttgaccaattgcgaaagagaaccagaagggctaagaagggtcagagtcaaaccagctccccagaagatatgcccaggctcagggtgatttaaaacaaaggaatcctgcctcaaaatgagtcatccacatttatgatcctttgatatttaagtggattgaattcaaaagtacttactgtgcatgctgttgagtacaagtcagtctggcaaatattttttcccttaaactcctaaggttgtacttgtttttctatattgattaagttttctgagcagccagttgactgacattctcattttacatgtttttagccatggaatttatatatatatgttacataatatatgtaacattatatatacctgttatataatatatatacatatataacaggtatatataatgttatataatatatataacattaatatataatatatatatatataccattaaaaatacaataataatatctacccactgctgaatttgtctggctaaaaaaaatacaataataacaatacaaggccctaaattcacttattctattcattttttatcccttctatatgtagcattggttctgtaatgggtcagaaggcatctaaattatatatttggtagagaatttgaggattttttgagtagtggaagttctgccctacttggtacttatctgatgtttgatcagaaacaaaccaagagcccaggttggtgacaagaaattggtttggtcattaccttgaaatgtatggatcaggagaatcaagagtagaagcagctctcttaccttgagcccatgaaatccctttagccttagtcaagtaccaagagcagctgagcaatatcttaatattgctttacaaggcagttgcagggatctgaagattacagagggattgctctcctttacctgaacacagccccttagcaatgtagcttcacatttcacttgcttaaatttatttctcgggagcctggtatctcaaggtaggatccacaaaacagtattggcctatagctcatgtttattcccttcccatttcccctttttctttcctacagagattcctgaggtagtaaagaaagtggtcctgactctaaaatatgctgtctgggtaaaaacaaaacagggagggaagagtcagcactctagtcagaatagccctggtaagacggcaggcatgattcctttcctgttaatattcctaccccagcccttagcaacacacacacacacacacaaagacagagagatggcatgcccaaaaaattgcatgcccacagtaattatttctctactttactttcatttgccatcagagccatttaccaacaggcaagtataacaaagaggtctgggttaaaatcagtagccccagaaagaatatgtttctcattacctccatgtgagtgtgaatgtgtgtgaatgtgagtgtgagcgtgtgtggaggcagcaaaaagtttaggtaaaccacctttgtccttttcagaaattaagaacacccatactatgggcttcaagaggacaggaagccaatgtttaataaaacctgctatttatcagcactgcccagacatgttacatacattatctcatttaatcttctaacaatcataggaaatagattttggggtttgggtttttttttcgaactcctttcctcaaatgattgttctgtcttggcctcccaaaatgctgggattacaggtgtaagccaccacacctagcccttcatgcatggagtcacagggaaaaaaccatggctttgaatcatttggtcttgtagaaccttggttctatcatttactaacaattttagcttttgcaagatctccatatgcaaaatgaggataattatatctgccttgtagcattgttgagaggattcaagatattgtctgcaaaacatctaagtcataaccagtcacacaacacctgtttaatatgtatagatttaattgttattcaccagaccttttttgagcaccaaactaataataggtaaataacaatttatgtctataattgaatatcaggttacctaatcacagacataaatcagattgcacctgcactttgcagaagcttacaatctggctggagagacaaatcaatataaaataaaatacaagcatgtgaattagcataataaagatattaacagaatacataagactctgaggcagaaatgtttaattctaccttaaggaattgggaaagtttcatatagtagaggagatgtttgatccaaacaaagaagtaggaatcatagctaatctgatggaaaagaaaagaaacaaaagttacagaagaagaaagagcatgaggcttaaaatggtgttaaatattctagagacggtcagcagcccgtgagcccaacaggccggaaacaaggtgacactagggccactgtctggagcagcatggtccaatgcaagtagacagcgagccacatttgtaattttaaattctctactagccacattaagaaataaaaaaacaggtaaattataattaataaattttacttaataaatacaaaatattatcattttgacatgtaatcaacactttttaaagtattaattatttttttaccatcttttaatgctaagtctttgaaatctgatgtgtatcttatacttacagcacatctcaatttggaccagccacatttcaaatgcccagtagacacatgtggctaccttattgggcactgcggtttagagtgattaatgaggttgaaggctcaggtcagtaccatgaacagtaccaacatttaagtcaggtgggagtggaagaatacaaagatgtcttgtggggagttggggaaaaagagaatttcaaaaagagactcatcatttccaaagataaattgtcatctttcactccccaatatagtcatcttccagcccttcccacctcagggaagggcaccagaatccctcctgtgtcaaatgggaacctaggggtcattcatgacacctcccactccctctgccaccatatgcaacgcatcccaacacctatcagtatgcctcctaaatatctctcaaatccatccacttcagtcctctaccacgcgtctccagtctacagcaaactgataatacctcttgttcagagtacaacaaagcccttagtactctacttgcacccactctagcatgctccaatttattccctccattgctgcagagcaattttttaattttaattttaatctgagtaaaaccttctgaggcctttcccaaagacagagctccttacaaggccctgcctctccaatccatctgtcatcagtcacctctttactccccaccccagcaacattggcttttgttgaattccttgtacttgccttgctcctcctgccacaggatctttgcacagtctattctgtctgtctgggatgctcttacctttctctttcatagtgattcttacccttcagatcttattttaagcagcatggcttcaagaagggtttttctgataagatgaaatcactattttagtattgatagcactgttttccttttttttctgagcattcattacaagttgcaactttgcatttaatgttctccatctcctccccactagactgtggggatgatgcatatgattttgttcagctttgcattctcagtgtttagctcattactataattcactcaatcatccatgcaccagacatttactgagcattgactagggagcaggggctctgctagctgtgggaggtgaacaaaactggaaagctgttctgggctgaggagctgtgggtctagaaatgctcctctgcagttccctgtggttcacttaggttttcaactaggagcaactgtatataaattacataatgatatcaagtacctattacacaatttctcctaccaattcacccagacacaattaatctttttttttagctgaaagagtaatgaaaccacaatgaagaggaaaattcagctgagaaaaccgactaacactccgtatccctggcactgattctaaccaaaagcaaatccttcatttctctaagacaatacataacaaatggttatccaagactgaattatttgtggacagaactttacactttttttgataatacaattatgaacaattttatcatattttcttaacattacaaagatgttttagcaacttttaaaaatcatttcccagatatgcatgggaccaactttaatattttaagttttattgcaaatattctaatacttttcaaatggaagaaaatgatggatgaacattttgtaggtgcagaatggttcaagtatggccaggatacattctcagctgaaactcagtgaagtgatgactgtatacagagacttgggagaaaggtcaagaaagcctccttttggaaagagaggaaggaaggaaaggagggagggagggagggaagaaggaagaaaggaaggaagaaaggaaggaagaaaggaaggaaggaaggaaggaaggaaggaaggaaggaaagaaggatcaatatttatcaagtacttgttaaatcaagctccatttttagcaccaagtttctcatttcagaggaagtgttgtgttataaaaggcttgtttttagaaaatttaccagaataaacttggtctacattagtataaagttgtcaaaatgcttaactacttaattaaaattaccaacacatatggcacttactatgcaagaagtgctgctctatgtgactgacgtgtattaactcatttaatcctcaccacagctctaagaagtagttactgttattaacttactgcatggatgaaaagattgagtcatagggaggtaaagtaacttgcccaaatcatagagccaataaaatataggactgggtttgaaacccagcagtttgaggttaaacccaaatcttaatcactatgccaaactgcctcttgaaactttttaattcttcttttaaagtatttcaaaaattgtatgactgcagactaaattcatatctttattacaggatgaaaaatacaaaagtcatataattacaatctactcacaactgaaaatccatcatatgaagacaaagcatctctaaaataaaatataagccaaggggaaatataatttatccaagctgatgcacatgctatttcaggtacataaagtctacttggttgtcacttaatgttaaaagtaatgtaaattataactggcaatactgtgatcacacaaggtaaatctacatataaactggtaagtgaactgtactgagtttggaaccactattatgtcaaatctccaactaaaatcttttttgaataccagctatttaggtaagagagaaagtccagtccatatactctacgtacttgtgctttctaaagcagaaaaagactccataataacaatgaattggtgaagaatataataaaaattatattgaaccacattttagtaactcttaactcaccttctagaatgctattaggtttaaccacataaaattgacaatatttgatcatgtttggcctacaaacatggcaattcatgtgtttcaactaataggaaagtcatacttcattatatataacaaaatctgagaaaatgcaagtcattttctctgaaaggaaggaccagtcagcagcccattaggagagcttttgagaatcgcagctctagaagacactgtttagaatcctccagcacaaaatgagttgctggtaaaaattcagggtggacatgctccattaacctaaaaacaaggccactgatttatgagagcagatgggtgtatatgacagcgtgataatgtttcttcaaaacttacccttggaggctgggaggagggaaacatggggagttattggttaatgggtacagagtttatgttgagacaatgaaaaacttttgggtatagatactggtgatggttatacaacactgtgaatgtatttaataccactgaattacatacttatagatggttcaaataataaatattatgttattatatattttaccacaataaaaacacccttggaatacaattaattttctctgttgcaaacttgctattgcaacttacttgaaataaataaggacattgatgtaattacaaagaaaacattctgacatccctctgaagacactgcagtggctgattctgttccattttagtgccccctttgactatgcatgcagtttaaactcagccactttgtgggaaatgttggcagcattttcagttccttggtccatcagagcttttacctgacaatctacacacacacgcacacacacacacacacagagtatatataccccatctgctgagaaccacatgcatcagctatttgggaatagaaatcatctaccttgaagctattggctgacatcccacatgttctggcagccacttcaagttgtcactatcagttgtctcatgtcaaacgagttaataagctcatttagagtcttggtgggcagatgtgcatgtaggtcaaagccttttctacagcaagaattgctggattactaatgattctttccctttaattaggcccagaacagaaatagcattcagactttgacgtctttgaaggaaaaacgttcacatcgtttggcggcttggctatgagtcttcatttaacagttatttataattaaaattgtaaagggattcttcctatacactgagcagtcacaacccttgttcaaaattgttgtcctgccagaagaaccagaaagcaaattactgtttttggacaactagaaaagctgacatgttcaagtaccctacacttaaaatagtttatatgaagccaaaaatacagtcattctgttaagagaattgtgaacttaaaacagttttttgtttgattaattattctttaccaagaaatgtaggaatctacatgttttcacttgatttacttcacttcaagtgataaattataaggaattatatcctgttacaaatcatgactttttaagtggttgaaagcaacatcatgatgttaggaaattgttaggtttttgacttatataagaactgaaatatatctacacaagatgcttgtttgaggagaaagtttaaaattctttataattgttcatatttgtgatgttgaactacttccaacccataactggaaacattagttatgtttagtaggttgacctagctactaagctaattttgagccaaaccaagtacttaaataatgaccaaaacaataatgtatttttaaaactactaaatcttcattagtgatttctattctaacgaaaatactggcatagaaaatgtaagactctaagttgtacacaagaaagtgtaaaaaatacaaattaaaccccaagtcttcatgccacttttagaagaaagtagaagtaacacattggattgtttaatgcacaggaagcttttgatggggtatgtcaacactgtcctgtttgtctttattacccaactatgttagaagaatggtcaatgttcccgactgttacatccttctctctggtttgctccacaactcattgccatctccttgacccttctactgaaattattcttttgaatcttcccaatgacctcaatattgccaaattaagttaccacataggcaactgcccacataacctgtcttcagtatgatactgttgaccactcatgccatttaaaaccttttattcactcattcattcaagaaatacttgttgcttcatgtaactgtgtgtgaattagtgtgcaaagcagaatttttgaatctcccagatagtggtgttcctgacccattgttcccaaatcttctgatttagacttttcaaaaatagtgatagacctgctcatatctgtccagttcttctgccaatggttcctatctgaaagaagactaggaatgattaacggtataatacatggaagctcaaaggagagaaacttgattagcacacttccagctcccagaaatatccacacatgcattcctaatatcatatctgaaaggaagacagccagccctcttaccaaaaccctttttcatagaacactttgaagaaaacaggatgttgtgtagggacgtttagcatgcttacagttttaagttcagggtctgtacatctagctcttgtttactgaatctcctcattagtatatcattaacctgaaaaatatatcctttgcttgggaacctcagaaactgggatggaagcttgaaaaagtagggttcggaaaagtagggtatccaaaaactgtggtgtggtgcaagcttcagggtgaactaaatatatcatgtactaccctcatcgccctcactgcaacgaactcctcttcaaacatggttgtagttcattcactaacagtaggtcttttgtccatttgggatgaatgtttgtgtcatttaccctgaccatatccatttattaaactgggccagtctagtgctatttctctatggattttcttaatatctcagaagtttaaattgaacataaagtaagaccaagtctcataggtaaaagaatgctaagtttcttacacttgactgtacagcaagaagaaaacacttaggacaaatatcctgcaggaatattatgaacgtcctagagtagaacaatggaaggagttaggagaagggaggcaattcattttttaagataaatatacaatactgcagtattttttaactgtttgaggattagcatatggtactttcccttgggaaaaaacatgagggatatctccttgtgccctttaggccttgaagctctaatgctggggtacttcgaaatgtcaccagctgcttcctgcacacgccactgtgcagtccctcctcccaaggcacaaagagagtcttggaaagagtggatttgcatgagatttgagaaggaaatgcccttcagaaataacctcagaaagacatcaagaaaatggcaaaaattacctaatataggctgggcaaacccagtgttccactgtgttgatttattcaaaattagttttggtaacttgtcctctgtgacttgaaaggcctaccaatcataagccattcttcctagtaattaaaggcctttttcaagggtcacatgtgattgcaacctgagccaccatgacagccccatggaaggcagcagcgttgggtttttaggggttcagtctttcctcagagcatagcgctgtctcctgagtcacaatttcagtttggtctcagggataaggcttcttgggcacttgtgtgattacaattctaactgatttccgagactattgagacgttccgttttttttcttttgagacagagtctcgctctgtcaccccagctggagtgcagtggtgcaatcttggctcacagcaacctctgcctcccgggttcaggcaacgctctgcctcagcctccagagtagctgggatcacaggcgcccgccaccacgcccggctaatttttgtgctgttagtagagacggggtttcaccatcttggccaggctggtcttgagtcttgaactcctgacctcgtgatccacctacctcggcctcccaaagtgctgggattacaggcgtgagccactgcgcctggctgagatgttcttatgaatgccacaagatgaccttcctgtgtggtagaggatgaggtggactctgagctaaggcttctttctgagaaacatctatgttttgttgctaaggcaacaaagtcattcagggcagactaggagctactttacatgtggaaagtattattgacagaaataatttgtgaaaatgggccaggagcacattttttcctgacttaacacatgcatttttttccttttgttctttggccaccttttctgaaaaccctttaatgaagaaaagccaatccctaaagcaacagaaagtgagcgtaattcaagagaaagaccatttgtaaattcatagacataggcaggccctatctagaacctctcgtggaatctttgcaaatgttgcaagtttaaaggtttctattttaaggtcttatatgaaatatagtatttgaaaatgcacaattagcattaccgttttctttctcccaagatattcccttccttttttttttttttttttttttttgagacggagtcttgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgatattcccttcctttttcctgcactttcagatgaagattaaaacccaggagaaatgcacctttcaacaaactgttgtccctagccagagtccaccagaagggaagacagatagaacttccacactgtcaaaaagaaatgcatttatttcaggccaaatattcaggaaattcagcaatttttcctaaagggataaatataatatggtagctaagagcagacttgtgggtttcaatactcagtctgtcccttactagctctgtagacttggacccattgcttaaactctttgtgccttagtagactaatctgtacaatggaaataagaatagatcatgtctcaaaaggtggtattagtattaaatgagcacttaaaactttacttatacataataaatatacaataaataaatgttaggtactgtacaagtttcaaaataaataatcttccttgtgcccattagagaatacagaattactgaattttagagggtttctttgcacaaattgcaaaagcagcttcttttaaaattgtctaataaaatgataatggataaaaataaatgtcactataaaatattatttccagattgaggaacaaaaatagcttattatgtcttcaaagtatagtacattctgggaggcaagatgaaatcattccctgaaaactgacttttatgacagtacactaataagtgtataaaatgaaaaaaatagctaatgaccaatatgacatgaatctccagctaacagatccaaagagcagtagaaattatatagaagttagtaatagtgtcaaagtaagagtacagaccttaaaccagaactatgactagaaagaaaagggggaactcatgcccacttcatagactccgagcgatccccaacattatctagaaattgacagctttttgattggcaatgaactttgttcacttggcagtgaactttgtgcttaaaacttaagtggcaatttcatgtcatgtatattttacaaaagagaggcccttgggaaattgatgaagtcctcaaatgcttttggaaaaatgactccttttatgattatgctgtaaaagtcaaccacaaagtgctattatgtcagaaaaattataaccaacccccccaaaacatacttgatgcattattaaaacttaatgcactgctgaaattaaaggccaaattttattgaaatatgtttttaaccctaagtgataacactattagacataaagagttgagccaggtatggtggctcacacttgtagtctcaactctttgggaggccaaggcaggaggattccttgaggccaggcattccagactcaactgggcaacaaagcgagagcccatctctacaaaaaaaaaaattataatttagccaggcacagtggtatgtgcctctagtcctagctattttggaggctgaggcaggagaatcacttgagcccaggaattcaagttgcagttggttatgatcatgccactgtactccagctgggggaacagagcaacatcctatctctaaaaaagagagagagaagaagaagaagaaaaggaggaggaggaacacctttttatggaccattccctaccataccaccacaactgccagccacgacctgcatcacccaaagctgcaggcactatttccaggccagcaccacctcagtgccctccacagatgatgggacctcactgggactctgcctcaggcaagccatttgatctccaggctttgtttctcatttccaaaatgaaaatgctaagccagtatgatctctaacatccctagtggctcaaacattctataattccatcatactgcaaaccccagctctgatccctgactgtaagcctctttctcacaaacatgaaaattgtcatcttaggtaatcaaagaattctaaaaattgtgtggtctgtcaaaatatatatttttttcttactgtaggattgtacctgtagccaatgcaattttatcaaaacttctgctcatcagtattcaacaaggccatttctttccccagagagaattaatcataggcaagaagtgaaaaagacagtttccccagttgaagcctaagcacatgcctgctgagaagcccattctattttaatttgccaattcaaagtggcctggtaaatcacacactgtcattatctcattaaaaatattatactgtcactctctttcctctctctcaagtagcccaactgctccctacaacttcagtttaatatcacccttaaaaagctggctttctttagggtcagttgaggatggcatcttctgcttttattactgccataaattccataccactcaaatcactaagtcgacaccatttactggatatttactatatccgtgaaatttactaagctttgagaagagttaaaaaggaactaaacagcttgttttagcaaattaatggtcactctcattggaaaagagagccttataaccaggcctttaaagatccctcccatctgcatctttttgttctgcgtggcttgtattcaacccctccctatttgtcttggctggttatctgtggactgatactacaagcatggtgctgatggttgagatttccctgtaattaaaaaaagcttgatttctgttggtataacaactgtaaatttccttcccctataaagtgtatattgaggtggcattacatttgagaaatagagtggtttgaattgtgtcacttgttattgctttttggtttctaatgagccataaaataaataaaagtcaggagtaagaaggaaacacagcaaagattctagataatggcttatagttaacaatatccctctttgaataacataataataaatgataaaggtatgctgctaacttcctgaatgcattaggacttaattctctgtatacatctgcaggttattatgcatttccaaaggtacttcctcaaagaatccattgacttttacctaataaaacatacattactatagcgcactaggggaaaggcactctgcctgtctttaatcaaagggtaagattaccttattgccttgaaacccctttgggcctgggtctcctggaggtccagtaattccctgctccaggatgaaaaccaagaattagttctgtgtacaaaaggccagcaggaatgaatcattctttagggtccctagagatcctggcgatcgaagttagactgtgtaactcagagctaaattgaaatcacattcaatcgagaagtgggatgagataaaatttcttgtgtcaaatacgtagcttccaaaatagcacttatgctaagagcaaacatttaattaacgagatgtttgtttactaaacctgtgtttccaacattattccaacgttcttgactccttttaaaaaatattttgccagttaagtatcttcttttttaaaatatctaaggcatatgtaactgacgttagagcttccaatgaacctgggataaccagaatgactgcctggctctgacatttccaggctaaagcaaagaagttagtggttaactagatggtgtctaggagattctgggtaaaattataattttctgtaggctttttgaaatactgaaattaactcctcacacagagcaccattataactttagaagagataagttcctaggctaggaaaagattcaaattattttctgaaatctatggatgtctaacttaaatgccttagagaatcagtccatattatagaacattatctagttatagaacaataaaaatatactgtgatttagataaaatgcataacttttccaactacattatagtagcagtgcaaaaatagttacatcctgcttttaaccacttgactttccatctttccagactcttaattttttaacttcatcccctaagctgctcactaatacttgcctgttggtacctatctttagggagtcttagttaagttaatgaaaacattagggaagttgtttccaaaatttattgcacattgtaatcttctgggtatcttaaacaatattaatgcctggcttcaatccccagacattctgatttaactggcagagggtgcaagtgggcaaggggatggtttaaaaactccccaggtgattctaattcaaacttagatttggttttaacccccttacctgaattcctctgggtccctttggtccatatggccctggggatccctgtggaataaaattgaaaataagtctctctaaatatacatcttcaacgtgcagtgattttaggtaggagggaaggaaatgtgttctcggtaattgccatcttccctggttatcttaacatcaaaggcaataaactgaaataatcctaattaacaagccaaggggtaggagtgtcaaactttccttcagtaaacaatctccatgaaaatacaattttagatgtaagtccgttgcctacatattgacattttggtcattttggttacagtaaagaaattactttataagattccttagagggctataaacttattggaatattatttccttccgacagggtaatgtcagttaaattaacaatgtagtgcatttccatgctatctagatcactcttttgctcatcttcaaaacactgaacgtggcaaaacactgtttatattcaatactcttctaatagaaaatatttcattcggtcccataaccaggaaaccctttaaaatttattttgtgagggagaacatagtctagtttttatttccccagatttccactttttttttttgcttatcaaagtacaacctgttaacaattgacacactttgacaattatagaaacatataaataaacaatttgaaaaatcacacagaagcaaatgctgttaacattttaggcatattttcgtccagttttattcccagtagattcctcttcaaataatgtgatcaaagtgtatgtctgattttgtgtcctacccatttggccttacactgtatcaaaaatatttttccggccaggcgtgctggctcacgcctgtaatcccagcactttgggaggccgaggcgggcggatcacgaggtcaggagatggagaccatcctggctaacacagtgaaaccctgtctctactaaaaatacaaaaaattagccgggcgtggtggcgggcacctgtagtcccagctactggggaggctgaggcaggagaatagcgtgaacccgggaggcggagcttgcagtgagctgagatcgcgccactgcactccagcctgggcaacagagcgagactctgtctcaaaaaaaaaaaaaaaatttcctttttccatgtcattaaaaactcatagtaaacagataatagtcaagaatagggaactaccataatttatttactcatttccctagctttgacctaatattataatgaacatctttatgtataaatctctgcccaacttctgattcactcctaagaatagtctactagaagaggatgatggaagcagagaccataagcacatttaaggttcaccggctgtcctttgtctctcatgccatatatagaaataaagagagagaaacttcctccataaagtttgtttgttaatcatttccactacccgagtatgagagagtgtatcttcatcttatgggctccccatcaacaattagtattatacattacttcactgtttgctaatttgataggtgatataatacttttgtatgtttgcttttggttgctggtgttgttgttgttgttgtttgagacagggtcttgctctgttgcccaggctggagtagctcactgcagcctctatctcccaggttcaagcaatcctcccacctcagcctccctagttgcccacactggtgatataataccttattgttttattgttggttttgttttgtttttgagatggagtcttactctgtcccccaggctggagtgcaatggcacaatctcggtccactgcaacctctgcctcccaggttcaagcaattctcctgctccagcctcccgagtagctgaaattacaggtgtgcaccaccatgcccagctaatttttgtatttttagtagagatagggtttcaccttgttagccaggcttgtctcaaactcctgacctctgatgacctgcccaccttggcctccaaaagtgttgggattacaggcataagccaccacgcccagcctattttgttttttttgagacagggtttcgctctgttacccaaactggagtagagtggcacaatgacagctcactgcagcctcaaccccctggactcaagcaatcttcccacctcagcttcccaagtatctggaattacaggcacatgtccaactaatttttaaattttttgtagagacggggcctcactatgttgcccaggctggtctcaaactcctggactcaagtgatcctcccacttcggcctaattttaatgtattaatttcacttatctgattgctactgtattcggatatttttcttatttattagccattttaatttccacttctctatctcttcatgttgttcatatgtttttctgaacaaacttgtgtaaactcttcgtgtcaaggactctatatctcatcagttctaaggcacattttttcacatttttatatctctgacattggggtatattttacagtcaattgcaccttacatttataattggcagtgggttttttttgttgttgttattcctttttggtatggaaaataatgggacatttaataatccctgacatcttagtcaatgaaatatgatatcctttgtcaaccattttaatttcatctagttttcccaggtattctttgactttcatttctattctattctatgtgtgtccctttttctgcattgccaatatccaggtccatcttccatgttcagttatactccaggaagaatctattcattttcacatttcccattttgaccagagataattaccaagcctaccttttgcagatccacctgactttaactctacagtactttaaaagcattcagaaagtctcaatctatttaaagtgtttagtttcatgggccaaagtcattatctcaccctcttctcctaaccttctgcctcattttctctccttgactcccttccagaattataacatagaaactgaaaaagtttggtatcttggtggcatgatgttaatagttcttaatataatgaaaactatttatttttactctgtacttttttggaccctttaacatcatgtttcagatatactctctgtatatatttggccttttgaggaactctttaacataatattatttccaaatttaagtgctttcattattgattgattgattgattgattgatttttgagacggagtcactctgtcacccaggctggagtgcagtggcacgatcttggctcactgcaacgtctgcctcctgggttcaagcaattttcctgtctcagcctcctgagtagctgggactacaggtgcacgccaccatgcctggctaatttttgtatttttagtagagatggtgtttcaccgtattggtcaggctggtctcaaactcctgacctcaggtgatccacccaccttggcctcccaaagtgctgggattacaggtgttagccactgcgttcagcctatatttattttttaaaataaaggtgaatatttatccaattgtttgtgtctacattttcaaaattccaaatctctatgtctagttgcaccacactgtttataactatttcactgactgatttcagagttcttcacactattttggaaagtgcctgttttcagtgtttgcatctggaaagcacttctaccctgacctaactgcagctttaattaactttgcaggttaaataattctttttaccataacattcagtgggcgtggcctccaaggttagggtgtcagaaaatgaagtcttaatggtccataaaaaaggcatttgggggttctattattgagttaggcatcactttgttttctaccacatgttttacagatgtgaaaaattgagccattgattccaactctagtagtgagatcaccataattcagcccaggaatttccccttaaggaaacgcaacccaaaagggatcacagctgtaagcagtttaaaaacatgttccttaccttgtcaccttttatccctggtttaccacattccccacgttcaccctaaaaaataaataagtgaaataaataagagaacacttgcagtcattcactattaagaatgtttgtttgtttgttttttaaattcccagcagactcttgtaacataagcactcttttggtttctacacaatattagcctcaatactgtgggttttatgggcattgaaatctgaatatttttacccaagagtcatccttaacttgacaggaataaatcaggaacaatgtaataaggtttgacatttttaagaaatggatgaaactagaagaaaaggaacctagcatctaatcacatattagatgccctttgcatatgtggtttaattgaatccacataacggtccagggagatcagctttatcattcttattttataattgagaacatttaaactcaacaagataatttccctctatcaaatagctagtaagtaaaagaatcagagtctgaacccagatactttaacttggaattcctattttttcaagaacaccatgcttcagcctgagtaccaaccttgaccacctagtagtgttcacctggagaaccgtgagagaaaggttctgaagtgagattgcatcgtgagttagtgggaacaggtgccatgatgagttagcgaggactgctgtaggagagccgggcttggcagcaagcatgctacatatttttcattattatgctctacttccctgtcttccctagaatattgctgaaaaaacaacatttgagttattctttagagtttatcagtgatagtttatcataaatattttatcttagttaatctgacattacctgtctgagataaatattaatccaattttatagattaaaattttgtaattaagaaggttaagtaaagagaatgtggtatacaatggaatattattcagcctttgagaaagaaatcctgtcatttgtaacaacatagatgaacctgaacctggaagacattatgtttagtgaaataagccaggaacagaaagacaaatatggcatgatctcacttatatgtgagatctaaaaaatttgaactcacagaagcacagagtagaagggtggttaccaggggtaattggtggaaacttgggaaatgttggccaaaggatacaaaactagttagataggagcaataagttcaagagatctattgttcaacacgatgactatcattaataacaatgtcttgtattgaaaatcactaaaagggtagattttaagcattctcaccacaaaaactgatcattatgtgaagtgatatatatgttaattagctcaatttagccattttataatgtatacatttatcaaattatattttatacaatacaataaatatgaactttttagatttgtccattaaattttttaaataaaactaaatatttttaaaaggttagtttcctcaagtagaaggagaattgggacctctgaatactaatccattatatcagacttttgaaacttctactacttagaactaaaaggtgacagtcagaaaaatgactaaagtttcataatcatagtaatattatctcctttataaatcactttagagttttcaaaatgcttttatatatatcgttattttgatcctcaattcaattctcattttcaagataaggaaacacaattggatatgtcaaatgatttacttaaatgtacaggctacccaatgactcctagtccagtgctctcaacactagcttctgctgctgcttctttattctgcctctgtactgctctagggcatgttactggaagtgccactacacaatgacaaggaaattacattcaaatgtaaatcaatgcactgcttctttcatcaaggaagtcttgctatgaaaaataaatgtcagctgaactttaaacagtatacgttgtaatatagtggatttatatgctggcggaagctttatcttgttgcagaatagcaacaaaccattcacagactggcagccagcctgcagaccacagtttcaacagcagtgctctatggagggaaatcacaactgtaacctccaattatggatgcaaagtgtgtgccatagcctttacattattgctaatccccatagcagccttgcgaggtatatatacatatctccactcacagataagcaaaatgaggctcagagacattacatactttgtccatgaccacaaatttgagtctgttaggctctcaagtccatgttcttatcagtcacctgtagctgaacaaggcacactatcataggctgcaagtcactttccattaacctgacatttctgcctagggtactgcctgggctcttgcaggcatcaggagcaggaaagagggaggtgtgactcttagagccagctatgcctctgatcaaaagcaatctgttctctcttcacatcctttcgtgagtcaaactgacccaggaaaaactgagctttcacttagaacaagttgaacatttatttctgaatgcaaatggaaaatcacttttgaagaatcaattagaaagcaattaatttaataattttggatgggaataaaatgagtcaaccaccaaaatataaaacagaaagtaccataaatacactcaaaatgcttttggctacaattcacattccatttgtccagacagatttgttagctataggggcctgaggaacagcatttgttttttggggggcacagattgccatcaatgaaaatattgtattcatgttatttgcctctgcaaaggcgttttcctttttggtgggctcattaatccctgtggaatggccacaactacatggtttcagaaagcgagtacttcagaaagccatgaacagatcagctctgttctcagcctctattttctgatgctgctgctcctggtgaaattctggtttgaatgtcgatggttcagggtcactttgctctgacagcttgtattttccaagtgagaactcttccagtgaatcaataattctccagaaagtgaaattaatcttttcaaaaaatatatgtataaagcttccttgtgttgataactacctcactatataaatcaaaatggaggagggggccacccactattttcctcaactatacacacagttgataattttacaactgtgaaacttttttagttttcccatattaatatttgttcctttcctcttcataatggcacttacatttgtagacaagccaacattttggaatacattgtcacgcccattatttgattctccaaccactctgtaaattaggcaggcctgtacaaattgtattccatccagttgaagaaacagatactccaagacattgagttacctaagttcttaaggctgctaagtgtagaatcatgggattccttacactcttccccttggagttctaacattgccagcgattaggatatatttattggcttacatgtaggctcacccctaatatttgcagggcccagggcaagagtgtaagtggaagcccacataccatgtgtctaaatagttgaaagttataactaaactaataatgttctggcttccttccttaacaaatatgtcttcaaaagggataaagaattaaaagacttatgaattcctcagaggtccttgccagacatagccccctgcagcctggccccaacttcccttcccacctccaactccttccacagcaagagcatgagcacacacgtgaagatgccccgggtagcacaacaaagcccgctacatgacctctcctgccccaacaaacagctaccattcggctccccctccagcctaggaaaatgatggatatggaaaggaggtttttgtatgccctcccagcagcaggccttttgaagtcttggctacccaatgcatgatccaggagaaggaagcacagacctcctgcagactcctggctccatgagaagcagggaggccagaggagactcagagctggaccctctaaagttctagcctctttctcatgcctgaaggttgtagccctgtaggatggaatggatgataggtgcatgttctgattcagatagaaaatctgataataacaagaactgtgggacagacttatcaatgaaccagtgagcactctcagaggttcctgagccccagtatgacttgttaatcccttttaaagcagtttggtatcctaacttgtaactcgcaaataatcatcaaatcatctaccaacccataccttttgtttgcttgtttgccaaatttactcccctgcaagctctacccaattggctgactcagtgaagtcagtggctcttcactgcttaaccaggataaatcctctcttttccctgggagaggatttggtgtctaggttttcacaggaagttaaacaccaagggtgcaacctatttgcagtattgctgaatctgtttgtgtaaagaaacttttagcctgcatacctgtgctgcatggcttataaattggggttctctattaaaataattcatgtttgcaaagctgaaggaggctggattctaatctcaggaatcatggtaccctccatcccttacaacacacatccatatgttaagttctattattattttatgttaactcaggaatgagggaatccagacttacaaaaataaagaaaataacttttattaagttcctaagtacacttatgtttctgtttttctttttgaaattctggtcaatctatttgttgttaccaacttaccttgtcacccttgtacccaggaattccctaatttaaaaagaaaataaaaagtaaaatatgatactctgaggcagaattagaataaggattaggtatttttcaattacaaggtataacaaaaacacatctatacagtctggaaaattagatcatagaaatgtaaactgttccacttctctttgtgcttggagaaatatacatttactgaggagaagaaaataatctgttttccctttatcacattttattctcagtttcaggtatttttccatatccagtttcttgccctttggcccaaaactagaggagataatgtacactgaaagtcattgtagaagtgatggcctataatggtcccttcaaaactgttatattgacttttaaactatgaactattgcagctaagaatgtttcatagagactctgaaagaaattggctttgaaaatgagctgagataatggcctttaaaatgtgtgtaaatatttgtatccattatggtcctccttacaaattcggtctaagatatataacatcaaggaaatgaaaggttcctttatcagccctaatgcgacagtgacctttaagctactgtcttttatctcacactaaataagaggccagcacttctactgtcttctgtgtgtcacccttgggaatcctgtacagccttttccattgtgtcactgcccatggccctttaagaaatacaatagtgaatattacatggcctgggaaatcaccagctctaagcagcagcaagtcctcttcaaatgggatttttttgtctttcatacagctatatttttcaaatatggaaatagaattgtcagatttattgagagctgaagaaacctatttaataaataagctattattacagttacatgtgagtcagactacaaaattttgttctatgcatgacttttttattaatactattatctatttatttatttatgtgtagagagagggtctcactatgttgctcaggctggtctcaaactagtggccttaagtgatctttgcacctaggcctcccaaagtgctggtattacaggtatgagtcactgtgcctggcctgactttttttacaaaaggaaacttcatgaaggaaataaaacttccaaatgtgtggtcaatgaggaatagaagataaacgtagaattctctcctatgagataataagctttttaaaaatacaagtactttatcttagttttatttttacatacttgtatgctttatatgtagaatatacctaagaaatgtttcctgaacacaaatttcagattttttgttgacattactaaactttctatcagattttttaatgaagttgattcaaaataccaagagaacagtttttaacatctctgggtctgagtccagggcacatccagggggacaagcagagaggggcaatgtcatatggtcttctttttatgcaccgtacacatctctgctatttgatacacttactgcaatgcccagaaaagtgcaaaataagaaatatactgtaattagttcttgggcaatatccactatcttctaatttggggtataagaaatcaaatagaatggtaaattttattatgtctgcagaattggattaacaaaagcatagtttagaccatgtagttcttatgctcctgaaattctaacttattctttatcttaaaaaacttaagaaataaagcaaacagttttctcattggagcctttcaccaatgtcaaattaagcatcagagaatttgatagggttgaacactcctgctcccattttcactctgttagctgagtattttctccccacatttccacttctaagatcatatctttctgattgccttcttgagccatcaagagcacaaggtagatagaaatcacttttgcacttgcactaagggggtcaaaatggtcaaccacaaaatcagtaacctaggatcactttcttaggaaggcattccagttgtgtacatacccctggacctctttctccagcttctcctttttgagcgttgccctgtgacaaacaaaaaacagtaaaaattccacagccctgaagagtgactgattgctcaataaaatgcattatacagaagattaatagcttagcccaattaggaaacatctttagtctttcccgttgacattttcactatgcaatctaggcaaaaaaaaaaaaaaaatagcaactcagataaactttgccctttgcagtgaagccagatgtgtagggtgcaggatccaggtaccttttcacagcttacaccacatcccagttgaacaacacagcgattgttctcaaatacatcattatactcacttggagccagtcactctggcttttctctaaggggctttggaatgttttccaaaatgtcctcaagagtgattgcttgatttcagcaagacttaagaaaatatattatgtggcacaaaattacaaaccaaagaaataaaatgtgaacttacatttataatgggtatttaacacaaaaaaaagaagacatgatagcatcagtttggacgtatataagatgagtgagtatagggttgtttggttgagcatgtgtgtgtatgttgtaaagctatccaaggctgctatattccctttccttgacaagcagacaattgccaaaaatgcttttatgcatttaacttttgatttttttcattacctctctaaaaactttctaatagggctgttttagagttcatttttgagttaatttttaatgtaatagttaactttgttagtatttgagtacctcttacttattgcctaatttttcccaaactatttgtgtcaagttacctgcaatgaaaagcaaaccagtttcactgccacattgctatcactagttattattgttttaatattgctgtgttaattgctataatgaaagaaatgtttttaaacgtcaaaacacacacaaaaacaaatgatgtgaactagaaaaccacttccagaaaaaaataatcctctggattccaaagtttctaaaatgtaagtatcactactaaaggatatctcattctctctatttaaatttattttattacctaatgaaattaaatgtgcttttacttttttctttactagttttgtttcctctcttgaaaattgtgttcagaaattaactcagtgtactgtagaaattaacccaatgtccattacatttgatgcaaatatttcctgatatttctatttctttaatattccttccttatattaggacattctcatgctgctaacaaagacacacctgagactgggtagtttataaagcaaagaggtttaatggactcacagttccacagtgctggggagacctcataatcatggaggaaggtgaagcaggaacaaagccacatcttacatggtgacaggcaagagagcttatgtaggggaacttccccttataaaaccatcagatctcatgtgacttactcactatcacaagaacagcatgggaaagacccgccccctatgatttaattacctcccaccagtctctcccaccacatgtgggaatcatgggagctacgtacaattcaagatgagatttgagtggggacataaccaaagcatatcactcccttttctttaattattatttttttcattacacagaattttgccttaaattttcacatagttatatctacttttctctttgtgattactgctgttgttcttgaacttggaaccaaaatcctaacaatgatctgaacagatgaatgttttctttaaaagcctgggattttttttgataggtacacagagaaaagaattcgagaagtccttgaagatgctctgggagtgagaaacaatctggtggtttttctatgattattgtcagtcagttaatcattaaaagtatacccattaaaaacacaagtgccagtgtcaatctgatatggaacacatattactagttgctgaatcatcatcctaaataagattggctgctatcgtttaagtactagtttctgtttattcaatgtccctaggtttcctaaacttactgactaaaatgttcatatatgttactcagaatttgtgaattcaagctaatagaaataagatagataatataggaagtggaaatcctgtattcttcacaaaagttgtcacatttttgccatatactacaatgctttttatttttaaaattgttgttttaaaaaaaaagtctagaaggagatacgctggtttaaagaaaagctgtttattcatttaccgggtttccttttggtcctcgctcacctttgatacctggatttccatgtgtaccctgaaggcaaagggaaaaaatattattttaagtaggaattctattgttttctatactttataataatttctgatcagttttgtttcctagaatgagggagaattgtaaaacctttacctgccaagcagaaattcaattctcttctccctttttctacaccaggaaaaccactgtcttgaattggcagattttctagatttgctcaaaagagaataatgtttctctcttcccaccaattacttcttcccaaaacaatcacttctcagcagttttgcaaacaaaatcaaactcatgcaaagatttaaaagagtagctgcaacaggcagaaggataggagttgttcccaatctctcttcattgtgggtcacttctacgattccctctgtcactcacttttaaaaggaccaagctagcttgcttgcctttggtcaaagaggttctgatatccaggagacaatctcaaaagatgggagaaaggagctctgtaatcctgttccagaaaagcattttgttttcctgttcctaatcaaccagaaagcttgcttttctgagaaatggtgttgggggtactcgataatgttaaataacatattctgtggcttatccctactaaaatgtgacaagaatgtgactaaaattgtcaggtgcttagcaattgtgagctttcttattgctcattttaaaatataaagaaatatttcttaccctggccatctcttggtgtcatagagataaacgaagactttataggaagggatggctaaacctttgctttagccaaagtcagcttctactggctgccccactatcatataacgcatctaactttgtatttggggagaaaaacatcccttgattggtaggatggtttgaaaaattgtaggctttggacccgagtctcaaggtaaaatttgtcacattctaattcattcacagtacacattcccctcccacccccaaatacaagcattagttgaaaatttttatccatgcattttgtgagattctccatagggcttcttctgaactctaaggatgatatttggaattatacaaataaatagaagactgaatgagcacgtgaatgctttatgaagataaatgttaaaaaaatgctcagcatttccagtgatctagatgtcatttcaaatgccttcccagtacagacatggcacctaccagttattaggccagaatataaagaaagcactccttcctggattatcttatcaaacaatgaatcatcatagtcaatcctgccatttatttttggttgccatgtgcttacttccatttcacagaactcaccctaatcccccaaagcatcgtgaccagcttcctgtccatgaggccacacggtgttgctgctgcactgctgcattcgtgtgaagccaacatttaactttcagagaggcttgtactccatgtttctagtaggataaagctttgcttaaagcactgattatttgtattagctttttctgtattcacttcactattgagaaattctggcttcaattattttatgaggaggaatataaatgtcctttgtgggaacaacttcaaaacacacctgccctcagttcaggtcagtaaaatcccaggcttatttctaaggatagaatgtgtccctttagaaataaaagaaagaagtagcatttccatttttcctcccatttccaaacaattgcttttcagcagtgcaaaatagccccgatgttttcaagagcgagtagagctatcattgctaggactttctgacttaagttcaaagtggaagtatactcacaggaggccctggatcacctggatctcccttctcacattcacaaatcttgcgttcacactgaatcaataatgaaatatgatattaacacacagtgaaattcaaattgtatgcagcatttcaaattgtatttcaaatacatttcaaagtgtatttcaaataaatttcaaatagcatttcaaattgtattcagtatataaccaactggagcactctcaaagaaattttaccttgcacatttatggatgttttgctctctctattaaattattccaggcaaatttatacctaccaagagctagctaacaaaatattattaaatttcagcatagttaaataaaagacatcccatcaaaaatacatgtataatatatagatgccagttaaaaggagaaaataaatattttcagtggacttttagaatttctgatccttctcttctatataacacatcaaagctcaataatataataatattaaatgctcctttactaggcaaaggaaaacatttgacttatagcatattttactaattgtaagataattgtaagatgcaccttcttcctcattttaacaactctgaaatcagaatgagtcttataacagctgttgaccaggttcagtcatgacaaagtagttgctttttgcacatgcacttcaaaacttacagaatgaaatgggagaaaattccagaacatacttaagaaatgcttcatcaccaatggttttgctggcatagaggtcagtattacgcagaaaaacaaggacatcaacaactcagacaaaaaatgattcagatttaccaggggtgtctaatcttttggcttccctgggccacattggaagaagaagaattgccttgggccacgcataaaatacactaacactaacgatagctgaagagcaaaaaaaaaaaaaaaaaaaaaaaaaaaaaagggccgtgcatacattttataacgtttttaaaaagtttataaatttgtgttggtccgcattcaaagtcatcctgggctgcatgtagcctgtgggccgcgagttggacaagcttgatttagagtctgatgtgaagaagttttagaaataaccaagttattttgcttacatattcccttatatgtatatatgaaagtgatacaggattttaaaatctacatccaaaatgtctaaaaacttatttccacaggtataaaataaaaagtgcaattaataagaagacactgtatcatagataagctagcaagggttttttcctttctttcttttctttttttttttttaaacgggagtctcactctgccaccaggctggaatgcagcagcaatcttggctcactgcaacctctgcctcctgggttcaagtgattctcctgcctcagcctcctgagtagctgggactacagtcatgcaccatcacccccagctaacttttttgtatttttagtagagacggggtttcagcatgttggccaggatggtctcgatctcctgacctcatgatccacctgcctcggcctcccaaactgctgggattacaggcgtgagcgaccatgcctggccgttttttttttcctttcttaatggtacataacataatggtatatccgaacatgtacaattcaataaaacatggtgtgacgtaggtttggttgactcctattattttatgcaacaatacttgtaaatttcctgatgttaaataagcagctcattgaacaaagctcagatgttccaaactctttcttttaagaaatgcatgtccaggacaggactcctcagcaagctgatgattatctattgtgctaaggctcgtccaatcttattggccagtttcctttgccacgtggtctggttgccatcatcaggctgccttttcttcacaataaggagaatgagctcaaagtcaattggcaggcagcaggggatgactctagactctgtctcttagctgggaaccctctgcctaacctagccaacaccaggaacaccccccaaaatagaggacctgatgtggctgatgtcagatacatgcttagaataaaggaagcacatcaaagtaagcaaaaactatgtagtttgctcatgactgatttctaaaatcactcctggagtcacattcaatatttcctactttttctaaattttccaacttgcattgaatatggtagtataaaagaaatcagatggctgcctcagaatagagtggctcattttaaaagaactaagcatttttatttagtcacacttaatcttctaatgtgaattataatgctgatttgataatgcaagtgtttggagtaattcgtagtaatcaaagcatgtggtgcttaccttcttttcaaataagatatcctacaagggaaaaaagaatgaagcattaactcgattgatagttctgcctccagctacttattagtcataactattccctatgggatatgaagtttccacaaagaatagcaattcagcctttttaaacttgtaaaagcaataaaaccaaccagccaaccacccaaggagcagtccgagccatgtaataataagagatataactaccattaaaaattaacctatattttctaggaacttcatcttactgcattctatgttttatcttttgtttcctttatcagctctgtaatctccataatttgactataaagttaatcagtcataatgacaaagctctcacttttacatacaaagactgaggcagaatatataattgtatattttcaattttttccatccctatgcacatatacatgcatctatttttcatgatttatttttcaagattaaaacaatatagtcataacttcatgaaatattaatgggtgttagatcatattaaaactcaaaaagagaaaattacaaagtccagtgacattttttgagatgatctgaattatgagaagacaaagatttccattattatgatcactaggggaggagttttctatttcaaatttgaaaagcctccaatatgatactttatttacagaatttcaacagaagccaaaaaagatactcagcttttaaatttaaacagtattaggaataatattttggtaaaaattttgaactgttcatagcaatatgcattacttatgtaaaagaggacttacatttataactggctaacttaggggaaaaactaagtgatagaaaagtaatacatatttcataataaaaaatgatcattatgaaaaacaaaaaaacaaatttaatgagtcttagtcaatcagactcaacctcttgctttgcaataaggaaacatggttccaccataatgtgactcaactgaggtaacacacttgggctgcacctcctgaccgtcttcagtgcatgtcatatgtaccatacaggaatgaattagccagaatatttttcaaaactattttaaatttataattttgcagaaatgtcatgatcttgtttttgtctaacacctaggcctcactaccatacttgaattcagtgggatattacctgacaagtgcactgaaggctgtgttggaagacaaacgctggaaagaaactaatctatgtttatatatagaattagtactttcttaacctagaaattatgtgtcaaaccagtgccttgtgatttcatctgaaggggtaatttacatacgataaaatagaaagatgaaggagcaagcactggaatatttgttgcaagatattaaaaatgcagaagctaacaaggaagttaaataagagtatgtagctttatgaaggatgctgcatccctttagttttatttttactttatttccgtacaaactaatactatagagggacgagataacaaaatgctttaatgatttaatagggaaaaaattaggctgggaattaagtgtcattctgggtttccatcccgtttcaacaattaactagctatgtggccttggacaagtcatacaatccttccaggtaattttctccatatataaaaaaggacaaagtttgactacatgatctcaggagctataaaaccctagccacagacactagctacaaaatttagagtctcacctaccacccctcccaaccaaacgattttaaattactagccatgtaaatccaggctgaaagcagatgagatatttgtatctttaagagctaggaggtcctatggagaaataggaactcagatacactgatagttttagttaaaatggtattaccctctgtagaacatttggttatgcctacaaggctgaagatggacctgctttatcacgaggctgccaggacaattcttgcttttgcctgttatcctgacatcctttctagacataccacagggaaattcttgcacttgcacatttcagcattcattgttttttgtaatgaaaaactgtaaataaaataattgccaatagtggaatggatcagcaaatgaaatactactcggcagttaaagtgaatgcattggatctacacatttcaacaaaatttccaaaaaaacattgagtgcaaaagcaagttgtagatagatacatacaatatgatctgatttattaaaatacgtaagatatttcaaaccacgtcagagagtggtttcctctgggagaaagagagagaaaagaaattcaaaagaagttcaacagaggcagtaaaacaactaataattcaagtcaaattgtaatatttaaaaaccactactgaaataaagaaaaatttaaatatttgtcactttaaaatcttttaacaatgagcaatatcttttttttttcttctttttgagatggagtctcgccctgtcacctaggctggcatgcagtggcatgatcttggctcactgcaacctccacctcctgggttcaagcaattctcctgcctcagcctctgaaatagctggaattacagagcacgccaacaagccagggtaatttttgtatttttagtagagacagggtttcatcatgtcggccaggctggtctcaaactcctgacctcaagtgatccacccaccttggcctcccaaagtgctgggattacaggtgtgagccaccgcacctagccacaataagcaatatcttaatcaatttttaaattcacgaattcagctcttactgtgcctgatgtgtaattttatacttttttcagttctttcttttaaaattcaatttcttctttgccatattgctctttagaaatatgtggcataaggcttaaaaccatagcaatgcaaaaaactatttttggaactcatttaattttgtgtttgctggaatttatatttctatggaaacaaaaatgaacccaaaactacacaatagataagactgtttcaaacaaagaacaaagccccatccctgagggctcttataggctataagccccaggaacagaggacaacacacagcaacccgagtaggaaggaggtcctaggccaggggcgggggagccgctaacaagatggcttcttggaataggtgggttttctggatggttttgaagagaggaatgcaaaggaccacccattgatggtatgctgtcctatatgtcaaagttgatgaggaaaaaagtcataaggactagtgtgggcaataagacaaaggaagtagttatgaggaacatttaaagggagtggatggaagggcccacatggacagagccggaggccttgggaggtggcgagggcttgcactcaggcagggaagcaggctgcaaggagaacagtgtcaaagcctgacgggaggccatgttcaatgacagactgggggcatgcttgagtttcaatgaaaaggataaatagggaaagggtctcatgacagcaaaagaagatgcagtcagaatttcattaatggattcatatatatggcatatattcacatatactatatatgcaaaaccagaatgctagaatggaatcaccaatttttcaaggagtataaggtttatgctgtgagaaggggacagaaaacatgtgagggatggacaaatatcacagcacatggaatgacagcaaagcactcggtaggcaaggggaacaaaccctgtgacaaaaaaattcaacttaaaatggtagcaaaatggccactataaaatctaaaacagaaaaataaggccctaaacagaggaagtcttgaaaaaatggaaagtgatcataattaatagattaagaaagcataggattctaaagatgatatagacatcatcacattgatctcttcttggtatgtgagggagggaataccttaaatttatgttttttaaaaatcgttcagaaaaaaagacaaatttgtcacaacccttatttccataaaggctttttaaatacttaacatcaaaggcaatagagggaaaaaattgtctttaattttcacatatcctctcttactcttctacaggaccaagtaatatatccaggactttggaatgaatttgtttgtttggtttcaatactattatgtaaattataataaaaatagcaataaaaatatattacatgtcttcttcaatttggagtcattaagtctcttttgagtaattcagaactaaaatgtttctatggggttcttacatgataattcctactagaggcatcaaggaatttgcaatgatttgttttgtctttgctcctgaagaatctattcattctgtatactcgtgtccattaaattcaactaaagtctattctacaataaaagggagtaaacttctgatacagaaaaaaaccctgatgagtttgaaaatcattatactgggtacaagaagcctgacacaaaaataatacatactatttgagtttgtataaaattctagaaagtatacactaatctagagtcacaaaagtaagatcagtagctcaggagcaaatggggtcttacaaagagatatgaggcaatttggggaggtgatggaaatgttctctatcctaattgtgttggtagtttcataggtgtgtacctatgtcaaaagctcatggaattgtgccctttaagttaatgcagttgtgtacttaaatcatacctaattaacttatttaaaaagtcaactacataattattttaaaataaaaagtttaaaaattcaactaaagatgtaatagaaagggattagataaagaatttttccaatggtctcatcaagagtcaagttctgggcccggcgcgatggctcacacctgtaatcccaacactttgggaggccgaggcgggcagatcacctgaggtcaggagtttgagaacagcctggccatctctactcaaaaatacaaaaaaatgagccgggcatggtggcaggcgcctgtaatgccagctacttgagaaactaaggcaggagaatcgcttgaacccgggaggcagagtttgcagtgaaccaagatcgtgccactgcactccagcctgggtgacaggagcaaaactctgtctcaaaaaaaaaaaaaaaaagagtcaagttctgccttctagatggtggcaatttgtaacattgaaagttggtataccattctttgaagagcctaataagcactttggatcctgtaagtgtttggaaagcagcacctccttctaaaaagtggtttattcatggagcttccatctgaacaaacaagctgaaatcacagatgctaaacaaacaagctgaagtcgccggatgctaaggaagagcagtattcagtcattttctgtttgcccaggaacagacaaacaattttgcttccagtctactgccaagagcctgtgttctcagtgaagcaggtgctctcagcgagggtgtatctggtgggaatatgaacaacctgagcctacacctgtggccaaacaaggagctgcctgtcccgcatcttctatggtcagctcttatccatcttaaggtgaagatgaataagtaacaacagcccactcatgaccacatcaccaggattctctcccacacgggctggagccctctgttttatgttcagtggtgaggaccccttaagtcatggcacaggcagggctaagtgttagccaggaaccactacaaatttccctttcatgcaaaagagctgctcagaatgagtacttaccttgagcaccacaggactgggcccatcagctctatctctgatctaggcataactctcccatttaccccgaatccccaaggaaaaaaaggctagaaacaatagtaactttggaggagggctgctaccaaactgtttcagagcagttctgattgagaaaatatttttttaaaaagcagttactatttcctctctcaatatgcctttatagggttaagcatgcaaactgtgaggtcttcaccggccttaaattttcaactacaaaatgggtataataacattacctacatcataagattgtggcaaacattgaataaaataaaatatataaagtgttcaggaaaatgcctaatacagagagagtactcaatacctaagagctattatttaggtaagaaaacctcagatcttatgctgaaagcaacagagagtaaaaagataagagtaatgttgagaaaaagatcgagggataagacaaaaggagcaaaacaatctctgaaatagagcctgagttttctgtgcaagctgtagaaaacagccatatgaaacgctcagtacataaaggacacctttgccttcctttctcaggaaatcaaagaaatccaagtttttaagaaaatcagtttttaacactcagccaatcaaccaatttatctctaggcgttttctccttgagaaatattgtgaagagggatttccttttgattgtggtgccgtgtgttttacaaagcagcaaggaaaggcttttatacacagctgagcaacaaacaaagaaaagctgaccagacctatcaagtgggactcattgatttgatgggagaaactgttgcttgactgcaggttgcagatgattttaaattggatgggcttgagaacatctaagaaagaaggaggtaattttaaaaattggaagtctatgaactttgagtagcataatgtaacaataggtgagacagagtcaaaaatactcagtcctttagaagagtaagagagaatatgtcaagattatgtcaaaaatacctgtacagatgtggaatgggaaaagaccaacttggtacaaatatagcctaacacctcaagttgagcacaacctgaatataagtcagcaatgttcatgattgtaggctgtataaacaggagcttaaggtatatgattggaaaataaccccttccaaaatcctcagcatcagctagcaataaagttaaaaatgcaattccagggaattagcctggaacttttccagattgtctggagtaaactgccaagaaagtggagtgacacttcagaaagattcttctttctgttttcagtgttaactctcattttctccatctttttgacccagtatctcttcttatgggatttacaacaaatatgtcaatattatgatgataactgtataatcaacccattaggtacctaccagacgatcttgaattttatctacaagggttggatcactcaacagtaaagtgggttcactggatgaatccccagaaatcaaacgaagtttggcttcattgactaccgtagaaagtgcaatggtgataaatgatattcctgaaattctggcatcttcagaaatactttgaacatctggattctttggatggtcgatgccatcagtcatcagcaaaaccactttcacaccatccttacgcccttctctcttaagtagcctagtggcattggaaatggcataataagagaaggtaccttgccctattaaattcatagacttgaccttctgcttaaatgtctgcaggtccttccaggaagaaaaaggtggatcaatttggacagagctgctaaactgaagggctgccagtttgatgtcatattccaaggagcgaccaggagtcaattggaaaatcttgtcactcaagctatccacaaaatctttctgtttatcaaagagggcaattttagaactttcagagctgtccacgatgaagacaatatctatgaaacaaatggagcctgaaacagaataaacaggttaggcaaaataattattcctatcatgaaacaaatttgcatacggaaagccctgaagtggtgtgttgtatattgtttggtgttgagagcagcgtgaggagagaaagagagacacgttggacagaaggcttcaattgtaaaaaactaaatgtctaagtttatgaattattttctccttgtaaaatcatgcaaattaaaaataaataagatatcttttattctgagcatcttttcaatgttaaacctgctgaaagtgggaggaaatgggaagtcaagatgcatcacattttaaaaatccaactaacactgagcatagttgtctagaagtaaatgatactctaattctcaggttgtgtcatattggtgagtccctatttttttttaaactttcttgaaatcaagggagaaaatgactataccccctataccaagagtaagtggagaagaaacctaacttaaacacaacttaagtttaaatcccagctctgtgtctcagtggttaatttgcctatggccttgagtatgccactcgacctgttaagacctcaatttttttaatctacactatgagtggcaatctccgtcctgcctattttacaaggttactgtgaggctcaaatgagataataagtgcacaagtgctcttattaaagactctgatgtgctataagtatgtaaggtatattatcatcatataattttatcaaagtagactatcacatgtatacatgtatatggcttgctatttatatcaaatgctatttagaaaaattcacataagtatttttaacaggctaaacttaaaaacaaacaatttttttttttttaccctggacatcacttttccttgcaagcaaatttgattttggtcctttctttctttgtccggatactgtttgactcgtaaacgctgacaaaagcaggagatagaagacaaaatatctgttccacattatggtagatggtgaaaaatcatctgtcttgtagcacctttaatagaaaagtcagttacaaatactttaataaaatatggtgtttgttatttttaaatttcaagccagcagggttgaaaactggcatgtgactggaaaaaagaggttttcattcatatttctagaaaaatattcacattgagattttgaaagatttcaatccaaataaatcatggcaccatgaccaaacatttattagtgaatatttctatatattcaaagaactatatttaagtattcttaattccgcattgtattttgaggagcatagagttgggagagccatttaaaaacatttcaatcccgctctatatgattactgtggttcaatcacagggtctgctttgacatttccaaattcttcagggggaattcagattgctatatggtcatttcattcactttcattataactgattcctgacaaatctagtattttgtagaactgtagacaaccaccaccctttcaggcttaatactacacacataacttcagtgagttcagaggtcaaggtaaaaattaaacgacccttctgtttccatagaaccccatctctcttttctaccctagctttggaaactttgtctccaccaggggttcaaagctgcatatgcaatgaatcaaaagagtatgagagcaaaaataatagatttgcttaaaagcaacactcttcttccagtgatggctaaaagaactaatggacagaaacgggacttaaagccaagaagcaccccctctgaatagccccgtgaaactatttttctgggtggattaacaacgaaaaatctaattctgtattaaaatcctcaatcttcatcagtcaatatgcctagctacacaccaactgactcttaaactgacagatttccctgggaggagaagactcatgtgttgctgcctcagtatacccaagagaatgggaacgagaaagcttatttcgaatcaatacttagtatggcttaaaaatgcttgcctgctgaaactttattgacttcaggagttctggaaaaggaatcacattttccttctttggcaccttgcctttaggggataagaatctgggaaatcatgagcacgatttttccagactctgagtagagagtggaaatatatgcaaaggcagtgaggagtgagatggagactgacttttttcatacatgccagatggataaaccccaaagggaaacaaaactgttgggttaggagaggaccaatggatggcttcatgccacagtctgctcctcacatagcatcatccagctggaagtgtattaaaagaactttggataggtatgaccaaacatcttgtgtagcaattggccaaatgccaactgatcctcagacaaggtatactaaaatgtaaagacagctgggtattaaaaacaaaacaaaaccaagaaatgtgctaaggaaacagaacacacaaaggccatctctcctcaagttgtccctttgctaaccaaggaaaaaaataaatgatgtacaactttaagtctgaaggttagtgtaaagataaggctatgtgaaaaacacagttgttattgcattttcaaaggggaaagggaataacaccatggccatggtattacatatgacttttctctttggttgagttcataccataaggaacatctcagaagttctggaaataagaggctgagaactgaattccattgagaactgagcaagattttataagcaacataatcaagcaactcttcaaaacccttcatgtaaggttttagaaatactggctttaaataaagatttatcttttcccaaaactaagcacctgctcttactgttttcttggcatataatcatgaatttgtacctgatccctgtatatatgatattcacaaacataacttttccattgacaataatcccagtatctcatattttgttcttatttgctctgacattgttaatctagctctcccaaaccaaagtcttgttatttctttctgtttccctattgtagccagaggacattttcatacctctctagatttgtttctctagcttgttagttctactgcttccctgaaatatctttctcgtttattaatttggcatcttgagagcccactcatttctaatcactttttaccatgttttattttgcctctgtttttaataattctcacctttctctctttctgatgtcacgtacaagcaaaataggtttcagaggaaacagtgccattagttaagtgaaagaaatgtgaacctctgtgtttactataggttacattttataaatgcagaaacaatcataattattaatcaaataccgtagttttacttttggcctaaaatttatttggggtaaatatcaggatcagtaaataaatccaagatactttattttttataatttttcaaaaataaaatgatcttatatcagagttcaccaactttagttacaatgtttgcatctcagtttctacacaaatagaaaatgattgaataaagactttattcaaattgacaaattagccaagttgtaaagtattctataactaattctgaattgtaaaccctgttccaaattaagaaaaagatgtcctaaaatatattaacatcgttgtaaaacaatttagaagactgtaaattaaaaatccatttcaaaataattttaagttttaaatttctacattttaacaatgttaatatttttctaataattgatttgaagtaattgcagagaatacaaactattgacaagctttctcacctaataattatgtaagtaagtcatttagtcttccacagttccttgatggtcctatctgatttcaagtgactaaaataaatctgttatgtcttaccttataaagtttgtcaaacaggaattaaagactagttgagtaaatgccaacagcaaggactgtggttgggggtgaagtta
